(12) United States Patent
Costa et al.

(10) Patent No.: US 10,494,633 B2
(45) Date of Patent: Dec. 3, 2019

(54) OLIGONUCLEOTIDES FOR INDUCING PATERNAL UBE3A EXPRESSION

(71) Applicants: ROCHE INNOVATION CENTER COPENHAGEN A/S, Hørsholm (DK); HOFFMANN-LA ROCHE INC., Little Falls, NJ (US)

(72) Inventors: Veronica Costa, Basel (CH); Maj Hedtjärn, Hørsholm (DK); Marius Hoener, Basel (CH); Ravi Jagasia, Basel (CH); Mads Aaboe Jensen, Hørsholm (DK); Christoph Patsch, Basel (CH); Lykke Pedersen, Hørsholm (DK); Søren Vestergaard Rasmussen, Hørsholm (DK)

(73) Assignee: Roche Innovation Center Copenhagen A/S, Basel (CH)

( * ) Notice: Subject to any disclaimer, the term of this patent is extended or adjusted under 35 U.S.C. 154(b) by 102 days.

(21) Appl. No.: 15/351,113

(22) Filed: Nov. 14, 2016

(65) Prior Publication Data
US 2017/0191064 A1    Jul. 6, 2017

Related U.S. Application Data

(63) Continuation of application No. PCT/EP2016/077383, filed on Nov. 11, 2016.

(30) Foreign Application Priority Data

Nov. 12, 2015 (EP) ..................... 15194367
Sep. 19, 2016 (EP) ..................... 16189502

(51) Int. Cl.
*C12N 15/11* (2006.01)
*A61K 48/00* (2006.01)
(Continued)

(52) U.S. Cl.
CPC ........ *C12N 15/1137* (2013.01); *C12N 5/0619* (2013.01); *C12N 5/0623* (2013.01);
(Continued)

(58) Field of Classification Search
CPC .............. C12N 15/113; C12N 15/1137; C12N 2310/321
See application file for complete search history.

(56) References Cited

FOREIGN PATENT DOCUMENTS

| WO | WO 93/07883 | 4/1993 |
|---|---|---|
| WO | WO 98/039352 | 9/1998 |

(Continued)

OTHER PUBLICATIONS

Angelman Syndrome Prevention I Cleveland Clinic. Downloaded from https://my.clevelandclinic.org/health/diseases/17978-angelman-syndrome/prevention on Feb. 11, 2019.*

(Continued)

*Primary Examiner* — Terra C Gibbs
(74) *Attorney, Agent, or Firm* — Fish & Richardson P.C.

(57) ABSTRACT

The present invention relates to oligonucleotides that are capable of inducing expression of ubiquitin-protein ligase E3A (UBE3A) from the paternal allele in animal or human neurons. The oligonucleotides target the suppressor of the UBE3A paternal allele by hybridization to SNHG14 long non-coding RNA downstream of SNORD109B. The present invention further relates to pharmaceutical compositions and methods for treatment of Angelman syndrome.

24 Claims, 2 Drawing Sheets

Specification includes a Sequence Listing.

(51) Int. Cl.
   C07H 21/02      (2006.01)
   C12N 15/113     (2010.01)
   C12N 5/0793     (2010.01)
   C12N 5/0797     (2010.01)
   G01N 33/50      (2006.01)

(52) U.S. Cl.
   CPC .......... *C12N 15/111* (2013.01); *C12N 15/113* (2013.01); *G01N 33/5014* (2013.01); *G01N 33/5058* (2013.01); *C12N 2310/11* (2013.01); *C12N 2310/20* (2017.05); *C12N 2310/315* (2013.01); *C12N 2310/321* (2013.01); *C12N 2310/322* (2013.01); *C12N 2310/3231* (2013.01); *C12N 2310/33* (2013.01); *C12N 2310/3341* (2013.01); *C12N 2310/341* (2013.01); *C12N 2310/346* (2013.01); *C12N 2310/351* (2013.01); *C12N 2320/34* (2013.01); *C12N 2500/38* (2013.01); *C12N 2500/44* (2013.01); *C12N 2501/01* (2013.01); *C12N 2501/11* (2013.01); *C12N 2501/115* (2013.01); *C12N 2501/119* (2013.01); *C12N 2501/13* (2013.01); *C12N 2501/41* (2013.01); *C12N 2501/60* (2013.01); *C12N 2501/727* (2013.01); *C12N 2501/999* (2013.01); *C12N 2503/02* (2013.01); *C12N 2506/45* (2013.01); *C12N 2533/52* (2013.01)

(56) References Cited

FOREIGN PATENT DOCUMENTS

| WO | WO 99/014226 | 3/1999 |
|----|----|----|
| WO | WO 00/047599 | 8/2000 |
| WO | WO 00/66604 | 11/2000 |
| WO | WO 01/23613 | 4/2001 |
| WO | WO 2004/046160 | 6/2004 |
| WO | WO 2007/031091 | 3/2007 |
| WO | WO 2007/090071 | 8/2007 |
| WO | WO 2007/134181 | 11/2007 |
| WO | WO 2007/146511 | 12/2007 |
| WO | WO 2008/113832 | 9/2008 |
| WO | WO 2008/150729 | 12/2008 |
| WO | WO 2008/154401 | 12/2008 |
| WO | WO 2009/006478 | 1/2009 |
| WO | WO 2009/067647 | 5/2009 |
| WO | WO 2009/090182 | 7/2009 |
| WO | WO 2009/124238 | 10/2009 |
| WO | WO 2010/036698 | 4/2010 |
| WO | WO 2010/077578 | 7/2010 |
| WO | WO 2011/017521 | 2/2011 |
| WO | WO 2011/156202 | 12/2011 |
| WO | WO 2012/064806 | 5/2012 |
| WO | WO 2012/143379 | 10/2012 |
| WO | WO 2013/033230 | 3/2013 |
| WO | WO 2013/154798 | 10/2013 |
| WO | WO 2014/004572 | 1/2014 |
| WO | WO 2014/076195 | 5/2014 |

OTHER PUBLICATIONS

Angelman syndrome—Natural Living Center. Downloaded from http://www.naturallivingcenter.net/ns/DisplayMonograph.asp?StoreID=b571dewxvcs92jj200akhmccqa7w8v75&DocID=condition-angelnnan#Prevention on Feb. 11, 2019.*

Boissart et al., "Differentiation from human pluripotent stem cells of cortical neurons of the superficial layers amenable to psychiatric disease modeling and high-throughput drug screening," Transl Psychiatry, Aug. 2013, 3:e294.

Deleavey and Damha, "Designing Chemically Modified Oligonucleotides for Targeted Gene Silencing," Chemistry and Biology, Aug. 24, 2012, 19(8):937-954.

Fluiter et al., "Filling the gap in LNA antisense oligo gapmers: the effects of unlocked nucleic acid (UNA) and 4′-C-hydroxymethyl-DNA modifications on RNase H recruitment and efficacy of an LNA gapmer," Mol. Biosyst., May 2009, 5(8):838-843.

Freier & Altmann, "The ups and downs of nucleic acid duplex stability: structure—stability studies on chemically-modified DNA:RNA duplexes," Nucl. Acid Res., Nov. 1997, 25(22):4429-4443.

International Search Report and Written Opinion in International Application No. PCT/EP2016/077383, dated Feb. 23, 2017, 12 pages.

Mangos et al., "Efficient RNase H-Directed Cleavage of RNA Promoted by Antisense DNA or 2′F-ANA Constructs Containing Acyclic Nucleotide Inserts," J. Am. Chem. soc., Jan. 2003, 125(3):654-661.

Meng et al., "Towards a therapy for Angelman syndrome by targeting a long non-coding RNA", Nature, vol. 518, No. 7539, Dec. 1, 2014 (Dec. 1, 2014), pp. 409-412, XP055265928, United Kingdom ISSN:0028-0836, DOI: 10.1038/nature13975.

Mitsuoka et al., "A bridged nucleic acid, 2′,4′-BNA COC : synthesis of fully modified oligonucleotides bearing thymine, 5-methylcytosine, adenine and guanine 2′,4′-BNA COC monomers and RNA-selective nucleic-acid recognition," Nucleic Acids Research, Jan. 9, 2009, 37(4), 1225-1238.

Santalucia, Jr., "A unified view of polymer, dumbbell, and oligonucleotide DNA nearest-neighbor thermodynamics," Proc Natl Acad Sci USA, Feb. 1998, 95:1460-1465.

* cited by examiner

(12) United States Patent
US 10,494,633 B2

OLIGONUCLEOTIDES FOR INDUCING PATERNAL UBE3A EXPRESSION

PRIORITY INFORMATION

This application is a continuation and claims priority to PCT/EP2016/077383, filed Nov. 11, 2016, which claims priority to EP15194367.7, filed Nov. 12, 2015 and EP161895024, filed Sep. 19, 2016. The contents of which are hereby incorporated by reference.

FIELD OF INVENTION

The present invention relates to oligonucleotides (oligomers) that are complementary to and hybridize to SNHG14 downstream of SNORD109B, leading to induction of paternal expression of Ubiquitin-protein ligase E3A (UBE3A) in an animal or human. The present invention further relates to pharmaceutical compositions and methods for treatment of Angelman syndrome.

BACKGROUND

Angelman syndrome is neuro-genetic disorder caused by deletion or inactivation of the UBE3A genes on the maternally inherited chromosome 15q11.2. The paternal copy of the UBE3A gene is subject to genomic imprinting and silencing in neurons by an endogenous antisense transcript of UBE3A, termed SNHG14 (also known as UBE3A-ATS) (Meng et al. 2012 Hum Mol Genet. Vol. 21 pp. 3001-12). Other cell types than neurons seem to express the UBE3A gene from both the maternal and paternal allele.

Angelman syndrome is characterized by severe intellectual and developmental disability, sleep disturbance, seizures, jerky movements, EEG abnormalities, frequent laughter or smiling, and profound language impairments.

WO 2012/064806 discloses a method of inducing UBE3A expression in a cell by using a topoisomerase inhibitor. The method can be used to treat Angelman syndrome. There is no disclosure of antisense oligonucleotides.

WO 2014/004572 discloses oligonucleotides with 2'-O-methoxyethyl-RNA (MOE) modifications targeting mouse UBE3A-ATS. The oligonucleotides are only tested in mice related assays. In the region downstream of MBII-52 snoRNA (also known as SNORD115) and upstream of the UBE3A pre-mRNA there is no conservation between mouse and human. *Oligonucleotides targeting mouse UBE3A-ATS* can therefore not be translated into oligonucleotides that will function in a human. There is no disclosure of oligonucleotides targeting human UBE3A-ATS.

OBJECTIVE OF THE INVENTION

The present invention identifies novel oligonucleotides which induce human paternal UBE3A expression in neuronal without affection expression of the paternal SNORD115, SNORD116 and SNRPN transcripts significantly.

SUMMARY OF INVENTION

The present invention relates to oligonucleotides targeting a nucleic acid capable of suppressing the expression of UBE3A and to treat or prevent diseases related to decreased activity of UBE3A, in particular in neuronal cells.

Accordingly, in a first aspect the invention provides oligonucleotides which comprise a contiguous nucleotide sequence of 10 to 30 nucleotides in length with at least 98% complementarity to the part of human SNHG14 long non-coding RNA corresponding to position 25278410 to 25419462 on human chromosome 15 version GRCh38.p2. This region is also resembled by SEQ ID NO: 1. The oligonucleotide can be an antisense oligonucleotide, preferably with a gapmer design. Preferably, the oligonucleotide is capable of inducing the expression of UBE3A, in particular paternal UBE3A expression in a neuron, by degradation, reduction or removal of the UBE3A suppressor, in particular by reduction of the SNHG14 long non-coding RNA transcript downstream of SNORD109B. The UBE3A re-expression is achieved, without significantly affecting the expression of SNORD115. The degradation of the target nucleic acid is preferably achieved via nuclease recruitment.

In a further aspect, the invention provides pharmaceutical compositions comprising the oligonucleotides of the invention and pharmaceutically acceptable diluents, carriers, salts and/or adjuvants.

In a further aspect, the invention provides methods for in vivo or in vitro induction of UBE3A expression in a target cell where expression of paternal UBE3A is suppressed, by administering an oligonucleotide or composition of the invention in an effective amount to said cell.

In a further aspect the invention provides methods for treating or preventing a disease, disorder or dysfunction associated with in vivo activity of UBE3A comprising administering a therapeutically or prophylactically effective amount of the oligonucleotide of the invention to a subject suffering from or susceptible to the disease, disorder or dysfunction.

In a further aspect the oligonucleotide or composition of the invention is used for the treatment or prevention of Angelman syndrome.

DEFINITIONS

Oligonucleotide

Figure 1:
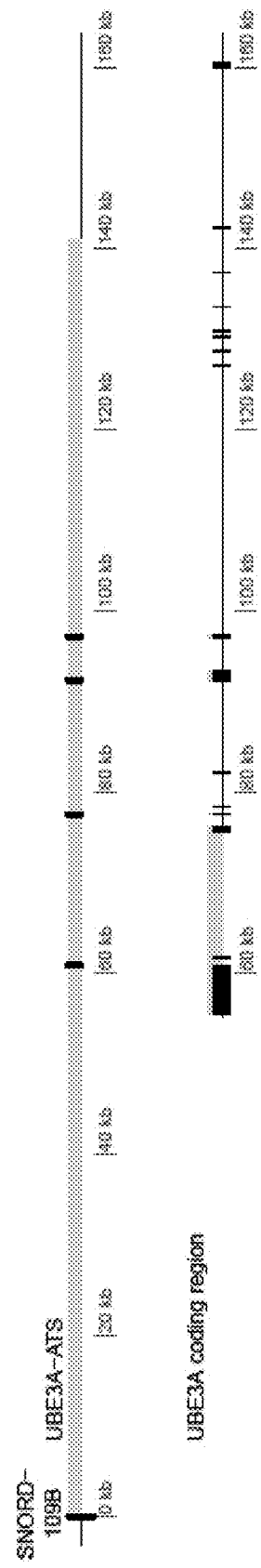
FIG. 1: The upper strand illustrates the region of the SNHG14 transcript downstream of SNORD109B (UBE3A-ATS) where the black boxes indicate the location of the tested mouse oligonucleotides. The lower strand illustrates the UBE3A coding region, where the black boxes indicate exons. Exon 1 is located around 160 kb. The oligonucleotides are placed in the antisense region of Exon 9 (positioned at ~97 kb), Exon 10 (positioned at ~92 kb), Exon 13 (positioned at ~77 kb) and the 5' end of Exon 16 (positioned at ~60 kb).

The term "oligonucleotide" as used herein is defined as it is generally understood by the skilled person as a molecule comprising two or more covalently linked nucleosides. Such covalently bound nucleosides may also be referred to as nucleic acid molecules or oligomers. Oligonucleotides are commonly made in the laboratory by solid-phase chemical synthesis followed by purification. When referring to a sequence of the oligonucleotide, reference is made to the sequence or order of nucleobase moieties, or modifications thereof, of the covalently linked nucleotides or nucleosides. The oligonucleotide of the invention is man-made, and is chemically synthesized, and is typically purified or isolated. The oligonucleotide of the invention may comprise one or more modified nucleosides or nucleotides.

Antisense Oligonucleotides

The term "Antisense oligonucleotide" as used herein is defined as oligonucleotides capable of modulating expression of a target gene by hybridizing to a target nucleic acid, in particular to a contiguous sequence on a target nucleic acid. The antisense oligonucleotides are not essentially double stranded and are therefore not siRNAs. Preferably, the antisense oligonucleotides of the present invention are single stranded.

Contiguous Nucleotide Sequence

The term "contiguous nucleotide sequence" refers to the region of the oligonucleotide which is complementary to the target nucleic acid. The term is used interchangeably herein with the term "contiguous nucleobase sequence" and the term "oligonucleotide motif sequence". In some embodiments all the nucleotides of the oligonucleotide are present in the contiguous nucleotide sequence. In some embodiments the oligonucleotide comprises the contiguous nucleotide sequence and may, optionally comprise further nucleotide(s), for example a nucleotide linker region which may be used to attach a functional group to the contiguous nucleotide sequence. The nucleotide linker region may or may not be complementary to the target nucleic acid.

Nucleotides

Nucleotides are the building blocks of oligonucleotides and polynucleotides, and for the purposes of the present invention include both naturally occurring and non-naturally occurring nucleotides. In nature, nucleotides, such as DNA and RNA nucleotides comprise a ribose sugar moiety, a nucleobase moiety and one or more phosphate groups (which is absent in nucleosides). Nucleosides and nucleotides may also interchangeably be referred to as "units" or "monomers".

Modified Nucleoside

The term "modified nucleoside" or "nucleoside modification" as used herein refers to nucleosides modified as compared to the equivalent DNA or RNA nucleoside by the introduction of one or more modifications of the sugar moiety or the (nucleo)base moiety. In a preferred embodiment the modified nucleoside comprises a modified sugar moiety. The term modified nucleoside may also be used herein interchangeably with the term "nucleoside analogue" or modified "units" or modified "monomers".

Modified Internucleoside Linkage

The term "modified internucleoside linkage" is defined as generally understood by the skilled person as linkages other than phosphodiester (PO) linkages, that covalently couples two nucleosides together. Nucleotides with modified internucleoside linkage are also termed "modified nucleotides". In some embodiments, the modified internucleoside linkage increases the nuclease resistance of the oligonucleotide compared to a phosphodiester linkage. For naturally occurring oligonucleotides, the internucleoside linkage includes phosphate groups creating a phosphodiester bond between adjacent nucleosides. Modified internucleoside linkages are particularly useful in stabilizing oligonucleotides for in vivo use, and may serve to protect against nuclease cleavage at regions of DNA or RNA nucleosides in the oligonucleotide of the invention, for example within the gap region of a gapmer oligonucleotide, as well as in regions of modified nucleosides.

In an embodiment, the oligonucleotide comprises one or more internucleoside linkages modified from the natural phosphodiester to a linkage that is for example more resistant to nuclease attack. Nuclease resistance may be determined by incubating the oligonucleotide in blood serum or by using a nuclease resistance assay (e.g. snake venom phosphodiesterase (SVPD)), both are well known in the art. Internucleoside linkages which are capable of enhancing the nuclease resistance of an oligonucleotide are referred to as nuclease resistant internucleoside linkages. In preferred embodiments at least 50% of the internucleoside linkages in the oligonucleotide, or contiguous nucleotide sequence thereof, are modified, such as at least 60%, such as at least 70%, such as at least 80 or such as at least 90% of the internucleoside linkages in the oligonucleotide, or contiguous nucleotide sequence thereof, are modified. In some embodiments all of the internucleoside linkages of the oligonucleotide, or contiguous nucleotide sequence thereof, are modified. It will be recognized that, in some embodiments the nucleosides which link the oligonucleotide of the invention to a non-nucleotide functional group, such as a conjugate, may be phosphodiester. In some embodiments all of the internucleoside linkages of the oligonucleotide, or contiguous nucleotide sequence thereof, are nuclease resistant internucleoside linkages.

Modified internucleoside linkages may be selected from the group comprising phosphorothioate, diphosphorothioate and boranophosphate. In preferred embodiments, the modified internucleoside linkages are compatible with the RNaseH recruitment of the oligonucleotide of the invention, for example phosphorothioate, diphosphorothioate or boranophosphate.

In some embodiments the internucleoside linkage comprises sulphur (S), such as a phosphorothioate internucleoside linkage.

A phosphorothioate internucleoside linkage is particularly useful due to nuclease resistance, beneficial pharmakokinetics and ease of manufacture. In preferred embodiments at least 50% of the internucleoside linkages in the oligonucleotide, or contiguous nucleotide sequence thereof, are phosphorothioate, such as at least 60%, such as at least 70%, such as at least 80 or such as at least 90% of the internucleoside linkages in the oligonucleotide, or contiguous nucleotide sequence thereof, are phosphorothioate. In some embodiments all of the internucleoside linkages of the oligonucleotide, or contiguous nucleotide sequence thereof, are phosphorothioate.

In some embodiments, the oligonucleotide comprises one or more neutral internucleoside linkage, particularly a internucleoside linkage selected from phosphotriester, methylphosphonate, MMI, amide-3, formacetal or thioformacetal.

Further internucleoside linkages are disclosed in WO2009/124238 (incorporated herein by reference). In an embodiment the internucleoside linkage is selected from linkers disclosed in WO2007/031091 (incorporated herein by reference). Particularly, the internucleoside linkage may be selected from —O—P(O)$_2$—O—, —O—P(O,S)—O—, —O—P(S)$_2$—O—, —S—P(O)$_2$—O—, —S—P(O,S)—O—, —S—P(S)$_2$—O—, —O—P(O)$_2$—S—, —O—P(O,S)—S—, —S—P(O)$_2$—S—, —O—PO(R$^H$)—O—, —O—PO(OCH$_3$)—O—, —O—PO(NR$^H$)—O—, —O—PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—CO—O—, —NR$^H$—CO—NR$^H$—, and/or the internucleoside linker may be selected form the group consisting of: —O—CO—O—, —O—CO—NR$^H$—, —NR$^H$—CO—CH$_2$—, —O—CH$_2$—CO—NR$^H$—, —O—CH$_2$—CH$_2$—NR$^H$—, CO—NR$^H$—CH$_2$—, —CH$_2$—NR$^H$CO—, —O—CH$_2$—CH$_2$—S—, —S—CH$_2$—CH$_2$—O—, —S—CH$_2$—CH$_2$—S—, —CH$_2$—SO$_2$—CH$_2$—, —CH$_2$—CO—NR$^H$—, —O—CH$_2$—CH$_2$—NR$^H$—CO—, —CH$_2$—NCH$_3$—O—CH$_2$—, where R$^H$ is selected from hydrogen and C1-4-alkyl.

Nuclease resistant linkages, such as phosphothioate linkages, are particularly useful in oligonucleotide regions capable of recruiting nuclease when forming a duplex with the target nucleic acid, such as region G for gapmers, or the non-modified nucleoside region of headmers and tailmers. Phosphorothioate linkages may, however, also be useful in non-nuclease recruiting regions and/or affinity enhancing regions such as regions F and F' for gapmers, or the modified nucleoside region of headmers and tailmers.

Each of the design regions may however comprise internucleoside linkages other than phosphorothioate, such as phosphodiester linkages, in particular in regions where modified nucleosides, such as LNA, protect the linkage against nuclease degradation. Inclusion of phosphodiester linkages, such as one or two linkages, particularly between or adjacent to modified nucleoside units (typically in the non-nuclease recruiting regions) can modify the bioavailability and/or bio-distribution of an oligonucleotide—see WO2008/113832, incorporated herein by reference.

In an embodiment all the internucleoside linkages in the oligonucleotide are phosphorothioate and/or boranophosphate linkages. Preferably, all the internucleoside linkages in the oligonucleotide are phosphorothioate linkages.

Nucleobase

The term nucleobase includes the purine (e.g. adenine and guanine) and pyrimidine (e.g. uracil, thymine and cytosine) moiety present in nucleosides and nucleotides which form hydrogen bonds in nucleic acid hybridization. In the context of the present invention the term nucleobase also encompasses modified nucleobases which may differ from naturally occurring nucleobases, but are functional during nucleic acid hybridization. In this context "nucleobase" refers to both naturally occurring nucleobases such as adenine, guanine, cytosine, thymidine, uracil, xanthine and hypoxanthine, as well as non-naturally occurring variants. Such variants are for example described in Hirao et al (2012) Accounts of Chemical Research vol 45 page 2055 and Bergstrom (2009) Current Protocols in Nucleic Acid Chemistry Suppl. 37 1.4.1.

In a some embodiments the nucleobase moiety is modified by changing the purine or pyrimidine into a modified purine or pyrimidine, such as substituted purine or substituted pyrimidine, such as a nucleobased selected from isocytosine, pseudoisocytosine, 5-methyl cytosine, 5-thiozolo-cytosine, 5-propynyl-cytosine, 5-propynyl-uracil, 5-bromouracil 5-thiazolo-uracil, 2-thio-uracil, 2'thio-thymine, inosine, diaminopurine, 6-aminopurine, 2-aminopurine, 2,6-diaminopurine and 2-chloro-6-aminopurine.

The nucleobase moieties may be indicated by the letter code for each corresponding nucleobase, e.g. A, T, G, C or U, wherein each letter may optionally include modified nucleobases of equivalent function. For example, in the exemplified oligonucleotides, the nucleobase moieties are selected from A, T, G, C, and 5-methyl cytosine. Optionally, for LNA gapmers, 5-methyl cytosine LNA nucleosides may be used.

Modified Oligonucleotide

The term modified oligonucleotide describes an oligonucleotide comprising one or more sugar-modified nucleosides and/or modified internucleoside linkages. The term chimeric" oligonucleotide is a term that has been used in the literature to describe oligonucleotides with modified nucleosides.

Complementarity

The term complementarity describes the capacity for Watson-Crick base-pairing of nucleosides/nucleotides. Watson-Crick base pairs are guanine (G)-cytosine (C) and adenine (A)-thymine (T)/uracil (U). It will be understood that oligonucleotides may comprise nucleosides with modified nucleobases, for example 5-methyl cytosine is often used in place of cytosine, and as such the term complementarity encompasses Watson Crick base-paring between non-modified and modified nucleobases (see for example Hirao et al (2012) Accounts of Chemical Research vol 45 page 2055 and Bergstrom (2009) Current Protocols in Nucleic Acid Chemistry Suppl. 37 1.4.1).

The term "% complementary" as used herein, refers to the number of nucleotides in percent of a contiguous nucleotide sequence in a nucleic acid molecule (e.g. oligonucleotide) which, at a given position, are complementary to (i.e. form Watson Crick base pairs with) a contiguous nucleotide sequence, at a given position of a separate nucleic acid molecule (e.g. the target nucleic acid). The percentage is calculated by counting the number of aligned bases that form pairs between the two sequences, dividing by the total number of nucleotides in the oligonucleotide and multiplying by 100. In such a comparison a nucleobase/nucleotide which does not align (form a base pair) is termed a mismatch.

The term "fully complementary", refers to 100% complementarity.

Hybridization

The term "hybridizing" or "hybridizes" as used herein is to be understood as two nucleic acid strands (e.g. an oligonucleotide and a target nucleic acid) forming hydrogen bonds between base pairs on opposite strands thereby forming a duplex. The affinity of the binding between two nucleic acid strands is the strength of the hybridization. It is often described in terms of the melting temperature (T$_m$) defined as the temperature at which half of the oligonucleotides are duplexed with the target nucleic acid. At physiological conditions T$_m$ is not strictly proportional to the affinity (Mergny and Lacroix, 2003, *Oligonucleotides* 13:515-537). The standard state Gibbs free energy ΔG° is a more accurate representation of binding affinity and is related to the dissociation constant (K$_d$) of the reaction by ΔG°=–RTln(K$_d$), where R is the gas constant and T is the absolute temperature. Therefore, a very low ΔG° of the reaction between an oligonucleotide and the target nucleic acid reflects a strong hybridization between the oligonucleotide and target nucleic acid. ΔG° is the energy associated with a reaction where aqueous concentrations are 1M, the pH is 7, and the temperature is 37° C. The hybridization of oligonucleotides to a target nucleic acid is a spontaneous reaction and for spontaneous reactions ΔG° is less than zero. ΔG° can be measured experimentally, for example, by use of the isothermal titration calorimetry (ITC) method as described in Hansen et al., 1965, *Chem. Comm.* 36-38 and Holdgate et al., 2005, *Drug Discov Today*. The skilled person will know that commercial equipment is available for ΔG° measurements. ΔG° can also be estimated numerically by using the nearest neighbor model as described by SantaLucia, 1998, *Proc Natl Acad Sci USA*. 95: 1460-1465 using appropriately derived thermodynamic parameters described by Sugimoto et al., 1995, *Biochemistry* 34:11211-11216 and McTigue et al., 2004, *Biochemistry* 43:5388-5405. In order to have the possibility of modulating its intended nucleic acid target by hybridization, oligonucleotides of the present invention hybridize to a target nucleic acid with estimated ΔG° values below −10 kcal for oligonucleotides that are 10-30 nucleotides in length. In some embodiments the degree or strength of hybridization is measured by the standard state Gibbs free energy ΔG°. The oligonucleotides may hybridize to a target nucleic acid with estimated ΔG° values below the range of −10 kcal, such as below −15 kcal, such as below −20 kcal and such as below −25 kcal for oligonucleotides that are 8-30 nucleotides in length. In some embodiments the oligonucleotides hybridize to a target nucleic acid with an estimated ΔG° value of −10 to −60 kcal, such as −12 to −40, such as from −15 to −30 kcal or −16 to −27 kcal such as −18 to −25 kcal.

The Target

The target refers to the protein which it is desired to modulate.

Target Nucleic Acid

A target nucleic acid is the intended target which the oligonucleotide of the invention hybridizes to, and may for example be a gene, a RNA, a non-coding RNA, a long non-coding RNA, a mRNA, and pre-mRNA, a mature mRNA or a cDNA sequence. In some embodiments the target nucleic acid is a non-coding RNA or a long non-coding RNA, or a subsequence thereof. For in vivo or in vitro application, the oligonucleotide of the invention is capable of decreasing the level of the SNHG14 transcript downstream of SNORD109B of and thereby relieving the suppression of the paternal UBE3A transcript in the intended target cell. The contiguous sequence of nucleobases of the oligonucleotide of the invention is complementary to the target nucleic acid, as measured across the length of the oligonucleotide, optionally with the exception of one or two mismatches, and optionally excluding nucleotide based linker regions which may link the oligonucleotide to an optional functional group such as a conjugate.

Target Sequence

The oligonucleotide comprises a contiguous nucleotide sequence which is complementary to or hybridizes to a sub-sequence of the target nucleic acid molecule. The term "target sequence" as used herein refers to a sequence of nucleotides present in the target nucleic acid which comprises the nucleobase sequence which is complementary to the oligonucleotide of the invention. In some embodiments, the target sequence consists of a region on the target nucleic acid which is complementary to the contiguous nucleotide sequence of the oligonucleotide of the invention. In some embodiments the target sequence is longer than the complementary sequence of a single oligonucleotide, and may, for example represent a preferred region of the target nucleic acid which may be targeted by several oligonucleotides of the invention.

The oligonucleotide of the invention comprises a contiguous nucleotide sequence which is complementary to the target nucleic acid, such as a target sequence.

The oligonucleotide comprises a contiguous nucleotide sequence of at least 8 nucleotides which is complementary to or hybridizes to a target sequence present in the target nucleic acid molecule. The contiguous nucleotide sequence (and therefore the target sequence) comprises of at least 8 contiguous nucleotides, such as 9, 10, 11, 12, 13, 14, 15, 16, 17, 18, 19, 20, 21, 22, 23, 24, 25, 26, 27, 28, 29 or 30 contiguous nucleotides, such as from 12-25, such as from 14-18 contiguous nucleotides.

Target Cell

The term a target cell as used herein refers to a cell which is expressing the target nucleic acid. In some embodiments the target cell may be in vivo or in vitro. In some embodiments the target cell is a mammalian cell such as a rodent cell, such as a mouse cell or a rat cell, or a primate cell such as a monkey cell or a human cell. In preferred embodiments the target cell is a neuronal cell.

Naturally Occurring Variant

The term "naturally occurring variant" refers to variants of SNHG14 transcript downstream of SNORD109B gene or transcripts which originate from the same genetic loci as the target nucleic acid, but may differ for example, by virtue of degeneracy of the genetic code causing a multiplicity of codons in the long non-coding RNA. The oligonucleotide of the invention may therefore be designed to target the target nucleic acid and naturally occurring variants thereof.

Modulation of Expression

The term "modulation of expression" as used herein is to be understood as an overall term for an oligonucleotide's ability to alter the amount of UBE3A protein when compared to the amount of UBE3A before administration of the oligonucleotide. Alternatively modulation of expression may be determined by reference to a control experiment where the oligonucleotide of the invention is not administered. The modulation effected by the oligonucleotide is related to it's ability to reduce, remove, prevent, lessen, lower or terminate the suppression of the paternal UBE3A transcript, e.g. by degradation or removal of the non-coding SNHG14 transcript downstream of SNORD109B or by blockage or prevention of polymerase activity associated with the SNHG14 transcript downstream of SNORD109B. The modulation can also be viewed as the oligonucleotide's ability to restore, increase or enhance expression of paternal UBE3A, e.g. by removal or blockage of inhibitory mechanisms affected by the non-coding SNHG14 transcript downstream of SNORD109B.

High Affinity Modified Nucleosides

A high affinity modified nucleoside is a modified nucleotide which, when incorporated into the oligonucleotide enhances the affinity of the oligonucleotide for its complementary target, for example as measured by the melting temperature ($T^m$). A high affinity modified nucleoside of the present invention preferably result in an increase in melting temperature between +0.5 to +12° C., more preferably between +1.5 to +10° C. and most preferably between +3 to +8° C. per modified nucleoside. Numerous high affinity modified nucleosides are known in the art and include for example, many 2' substituted nucleosides as well as locked nucleic acids (LNA) (see e.g. Freier & Altmann; Nucl. Acid Res., 1997, 25, 4429-4443 and Uhlmann; Curr. Opinion in Drug Development, 2000, 3(2), 293-213).

Sugar Modifications

The oligomer of the invention may comprise one or more nucleosides which have a modified sugar moiety, i.e. a modification of the sugar moiety when compared to the ribose sugar moiety found in DNA and RNA.

Numerous nucleosides with modification of the ribose sugar moiety have been made, primarily with the aim of improving certain properties of oligonucleotides, such as affinity and/or nuclease resistance.

Such modifications include those where the ribose ring structure is modified, e.g. by replacement with a hexose ring (HNA), or a bicyclic ring, which typically have a biradicle bridge between the C2 and C4 carbons on the ribose ring (LNA), or an unlinked ribose ring which typically lacks a bond between the C2 and C3 carbons (e.g. UNA). Other sugar modified nucleosides include, for example, bicyclohexose nucleic acids (WO2011/017521) or tricyclic nucleic acids (WO2013/154798). Modified nucleosides also include nucleosides where the sugar moiety is replaced with a non-sugar moiety, for example in the case of peptide nucleic acids (PNA), or morpholino nucleic acids.

Sugar modifications also include modifications made via altering the substituent groups on the ribose ring to groups other than hydrogen, or the 2'-OH group naturally found in DNA and RNA nucleosides. Substituents may, for example be introduced at the 2', 3', 4' or 5' positions. Nucleosides with modified sugar moieties also include 2' modified nucleosides, such as 2' substituted nucleosides. Indeed, much focus has been spent on developing 2' substituted nucleosides, and numerous 2' substituted nucleosides have been found to have beneficial properties when incorporated into oligonucleotides, such as enhanced nucleoside resistance and enhanced affinity.

2' Modified Nucleosides.

A 2' sugar modified nucleoside is a nucleoside which has a substituent other than H or —OH at the 2' position (2' substituted nucleoside) or comprises a 2' linked biradicle, and includes 2' substituted nucleosides and LNA (2'-4' biradicle bridged) nucleosides. For example, the 2' modified sugar may provide enhanced binding affinity and/or increased nuclease resistance to the oligonucleotide. Examples of 2' substituted modified nucleosides are 2'-O-alkyl-RNA, 2'-O-methyl-RNA, 2'-alkoxy-RNA, 2'-O-methoxyethyl-RNA (MOE), 2'-amino-DNA, 2'-Fluoro-RNA, and 2'-fluoro-ANA (F-ANA). For further examples, please see e.g. Freier & Altmann; Nucl. Acid Res., 1997, 25, 4429-4443 and Uhlmann; Curr. Opinion in Drug Development, 2000, 3(2), 293-213; and Deleavey and Damha, Chemistry and Biology 2012, 19, 937. Below are illustrations of some 2' substituted modified nucleosides.

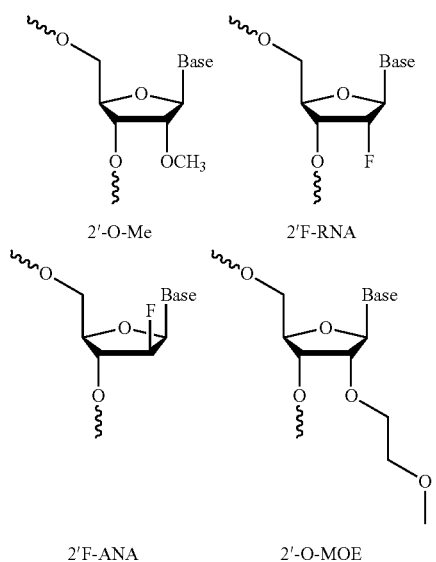

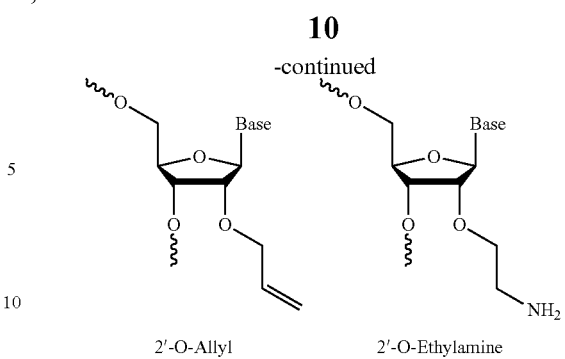

Locked Nucleic Acid Nucleosides (LNA).

LNA nucleosides are modified nucleosides which comprise a linker group (referred to as a biradicle or a bridge) between C2' and C4' of the ribose sugar ring of a nucleotide. These nucleosides are also termed bridged nucleic acid or bicyclic nucleic acid (BNA) in the literature.

In some embodiments, the modified nucleoside or the LNA nucleosides of the oligomer of the invention has a general structure of the formula I or II:

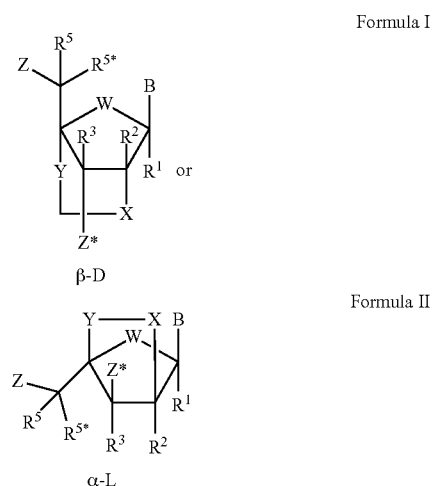

wherein W is selected from —O—, —S—, —N($R^a$)—, —C($R^a R^b$)—, such as, in some embodiments —O—;

B designates a nucleobase or modified nucleobase moiety;

Z designates an internucleoside linkage to an adjacent nucleoside, or a 5'-terminal group;

Z* designates an internucleoside linkage to an adjacent nucleoside, or a 3'-terminal group;

X designates a group selected from the list consisting of —C($R^a R^b$)—, —C($R^a$)=C($R^b$)—, —C($R^a$)=N—, —O—, —Si($R^a$)$_2$—, —S—, —SO$_2$—, —N($R^a$)—, and >C=Z In some embodiments, X is selected from the group consisting of: —O—, —S—, NH—, N$R^a R^b$, —CH$_2$—, CR$^a R^b$, —C(=CH$_2$)—, and —C(=CR$^a R^b$)—

In some embodiments, X is —O—

Y designates a group selected from the group consisting of —C($R^a R^b$)—, —C($R^a$)=C($R^b$)—, —C($R^a$)=N—, —O—, —Si($R^a$)$_2$—, —S—, —SO$_2$—, —N($R^a$)—, and >C=Z In some embodiments, Y is selected from the group consisting of: —CH$_2$—, —C($R^a R^b$)—, —CH$_2$CH$_2$—, —C($R^a R^b$)—C($R^a R^b$)—, —CH$_2$CH$_2$CH$_2$—, —C($R^a R^b$)C($R^a R^b$)C($R^a R^b$)—, —C($R^a$)=C($R^b$)—, and —C($R^a$)=N—

In some embodiments, Y is selected from the group consisting of: —CH$_2$—, —CHR$^a$—, —CHCH$_3$—, CR$^a$R$^b$— or —X—Y— together designate a bivalent linker group (also referred to as a radical) together designate a bivalent linker group consisting of 1, 2, 3 or 4 groups/atoms selected from the group consisting of —C(R$^a$R$^b$)—, —C(R$^a$)=C(R$^b$)—, —C(R$^a$)=N—, —O—, —Si(R$^a$)$_2$—, —S—, —SO$_2$—, —N(R$^a$)—, and >C=Z, In some embodiments, —X—Y— designates a biradicle selected from the groups consisting of: —X—CH$_2$—, —X—CR$^a$R$^b$—, —X—CHR$^a$—, —X—C(HCH$_3$)—, —O—Y—, —O—CH$_2$—, —S—CH$_2$—, —NH—CH$_2$—, —O—CHCH$_3$—, —CH$_2$—O—CH$_2$—, —O—CH(CH$_3$CH$_3$)—, —O—CH$_2$—CH$_2$—, OCH$_2$—CH$_2$—CH$_2$—, —O—CH$_2$OCH$_2$—, —O—NCH$_2$—, —C(=CH$_2$)—CH$_2$—, —NR$^a$—CH$_2$—, N—O—CH$_2$, —S—CR$^a$R$^b$— and —S—CHR$^a$—.

In some embodiments —X—Y— designates —O—CH$_2$— or —O—CH(CH$_3$)—.

wherein Z is selected from —O—, —S—, and —N(R$^a$)—, and R$^a$ and, when present R$^b$, each is independently selected from hydrogen, optionally substituted C$_{1-6}$-alkyl, optionally substituted C$_{2-6}$-alkenyl, optionally substituted C$_{2-6}$-alkynyl, hydroxy, optionally substituted C$_{1-6}$-alkoxy, C$_{2-6}$-alkoxyalkyl, C$_{2-6}$-alkenyloxy, carboxy, C$_{1-6}$-alkoxycarbonyl, C$_{1-6}$-alkylcarbonyl, formyl, aryl, aryloxy-carbonyl, aryloxy, arylcarbonyl, heteroaryl, heteroaryloxy-carbonyl, heteroaryloxy, heteroarylcarbonyl, amino, mono- and di(C$_{1-6}$-alkyl)amino, carbamoyl, mono- and di(C$_{1-6}$-alkyl)-aminocarbonyl, amino-C$_{1-6}$-alkyl-aminocarbonyl, mono- and di(C$_{1-6}$-alkyl)amino-C$_{1-6}$-alkyl-aminocarbonyl, C$_{1-6}$-alkylcarbonylamino, carbamido, C$_{1-6}$-alkanoyloxy, sulphono, C$_{1-6}$-alkylsulphonyloxy, nitro, azido, sulphanyl, C$_{1-6}$-alkylthio, halogen, where aryl and heteroaryl may be optionally substituted and where two geminal substituents R$^a$ and R$^b$ together may designate optionally substituted methylene (=CH$_2$), wherein for all chiral centers, asymmetric groups may be found in either R or S orientation.

wherein R$^1$, R$^2$, R$^3$, R$^5$ and R$^{5*}$ are independently selected from the group consisting of: hydrogen, optionally substituted C$_{1-6}$-alkyl, optionally substituted C$_{2-6}$-alkenyl, optionally substituted C$_{2-6}$-alkynyl, hydroxy, C$_{1-6}$-alkoxy, C$_{2-6}$-alkoxyalkyl, C$_{2-6}$-alkenyloxy, carboxy, C$_{1-6}$-alkoxycarbonyl, C$_{1-6}$-alkylcarbonyl, formyl, aryl, aryloxy-carbonyl, aryloxy, arylcarbonyl, heteroaryl, heteroaryloxy-carbonyl, heteroaryloxy, heteroarylcarbonyl, amino, mono- and di(C$_{1-6}$-alkyl)amino, carbamoyl, mono- and di(C$_{1-6}$-alkyl)-amino-carbonyl, amino-C$_{1-6}$-alkyl-aminocarbonyl, mono- and di(C$_{1-6}$-alkyl)amino-C$_{1-6}$-alkyl-aminocarbonyl, C$_{1-6}$-alkyl-carbonylamino, carbamido, C$_{1-6}$-alkanoyloxy, sulphono, C$_{1-6}$-alkylsulphonyloxy, nitro, azido, sulphanyl, C$_{1-6}$-alkylthio, halogen, where aryl and heteroaryl may be optionally substituted, and where two geminal substituents together may designate oxo, thioxo, imino, or optionally substituted methylene.

In some embodiments R$^1$, R$^2$, R$^3$, R$^5$ and R$^{5*}$ are independently selected from C$_{1-6}$ alkyl, such as methyl, and hydrogen.

In some embodiments R$^1$, R$^2$, R$^3$, R$^5$ and R$^{5*}$ are all hydrogen.

In some embodiments R$^1$, R$^2$, R$^3$, are all hydrogen, and either R$^5$ and R$^{5*}$ is also hydrogen and the other of R$^5$ and R$^{5*}$ is other than hydrogen, such as C$_{1-6}$ alkyl such as methyl.

In some embodiments, R$^a$ is either hydrogen or methyl. In some embodiments, when present, R$^b$ is either hydrogen or methyl.

In some embodiments, one or both of R$^a$ and R$^b$ is hydrogen

In some embodiments, one of R$^a$ and R$^b$ is hydrogen and the other is other than hydrogen In some embodiments, one of R$^a$ and R$^b$ is methyl and the other is hydrogen In some embodiments, both of R$^a$ and R$^b$ are methyl.

In some embodiments, the biradicle —X—Y— is —O—CH$_2$—, W is O, and all of R$^1$, R$^2$, R$^3$, R$^5$ and R$^{5*}$ are all hydrogen. Such LNA nucleosides are disclosed in WO99/014226, WO00/66604, WO98/039352 and WO2004/046160 which are all hereby incorporated by reference, and include what are commonly known as beta-D-oxy LNA and alpha-L-oxy LNA nucleosides.

In some embodiments, the biradicle —X—Y— is —S—CH$_2$—, W is O, and all of R$^1$, R$^2$, R$^3$, R$^5$ and R$^{5*}$ are all hydrogen. Such thio LNA nucleosides are disclosed in WO99/014226 and WO2004/046160 which are hereby incorporated by reference.

In some embodiments, the biradicle —X—Y— is —NH—CH$_2$—, W is O, and all of R$^1$, R$^2$, R$^3$, R$^5$ and R$^{5*}$ are all hydrogen. Such amino LNA nucleosides are disclosed in WO99/014226 and WO2004/046160 which are hereby incorporated by reference.

In some embodiments, the biradicle —X—Y— is —O—CH$_2$—CH$_2$— or —O—CH$_2$—CH$_2$—CH$_2$—, W is O, and all of R$^1$, R$^2$, R$^3$, R$^5$ and R$^{5*}$ are all hydrogen. Such LNA nucleosides are disclosed in WO00/047599 and Morita et al, Bioorganic & Med. Chem. Lett. 12 73-76, which are hereby incorporated by reference, and include what are commonly known as 2'-O-4'C-ethylene bridged nucleic acids (ENA).

In some embodiments, the biradicle —X—Y— is —O—CH$_2$—, W is O, and all of R$^1$, R$^2$, R$^3$, and one of R$^5$ and R$^{5*}$ are hydrogen, and the other of R$^5$ and R$^{5*}$ is other than hydrogen such as C$_{1-6}$ alkyl, such as methyl. Such 5' substituted LNA nucleosides are disclosed in WO2007/134181 which is hereby incorporated by reference.

In some embodiments, the biradicle —X—Y— is —O—CR$^a$R$^b$—, wherein one or both of R$^a$ and R$^b$ are other than hydrogen, such as methyl, W is O, and all of R$^1$, R$^2$, R$^3$, and one of R$^5$ and R$^{5*}$ are hydrogen, and the other of R$^5$ and R$^{5*}$ is other than hydrogen such as C$_{1-6}$ alkyl, such as methyl. Such bis modified LNA nucleosides are disclosed in WO2010/077578 which is hereby incorporated by reference.

In some embodiments, the biradicle —X—Y— designate the bivalent linker group —O—CH(CH$_2$OCH$_3$)— (2'O-methoxyethyl bicyclic nucleic acid—Seth at al., 2010, J. Org. Chem. Vol 75(5) pp. 1569-81). In some embodiments, the biradicle —X—Y— designate the bivalent linker group —O—CH(CH$_2$CH$_3$)-(2'O-ethyl bicyclic nucleic acid—Seth at al., 2010, J. Org. Chem. Vol 75(5) pp. 1569-81). In some embodiments, the biradicle —X—Y— is —O—CHR$^a$—, W is O, and all of R$^1$, R$^2$, R$^3$, R$^5$ and R$^{5*}$ are all hydrogen. Such 6' substituted LNA nucleosides are disclosed in WO10036698 and WO07090071 which are both hereby incorporated by reference.

In some embodiments, the biradicle —X—Y— is —O—CH(CH$_2$OCH$_3$)—, W is O, and all of R$^1$, R$^2$, R$^3$, R$^5$ and R$^{5*}$ are all hydrogen. Such LNA nucleosides are also known as cyclic MOEs in the art (cMOE) and are disclosed in WO07090071.

In some embodiments, the biradicle —X—Y— designate the bivalent linker group —O—CH(CH$_3$)—.—in either the R- or S-configuration. In some embodiments, the biradicle —X—Y— together designate the bivalent linker group —O—CH$_2$—O—CH$_2$— (Seth at al., 2010, J. Org. Chem). In some embodiments, the biradicle —X—Y— is —O—CH (CH$_3$)—, W is O, and all of R$^1$, R$^2$, R$^3$, R$^5$ and R$^{5*}$ are all hydrogen. Such 6' methyl LNA nucleosides are also known as cET nucleosides in the art, and may be either (S)cET or (R)cET stereoisomers, as disclosed in WO07090071 (beta-D) and WO2010/036698 (alpha-L) which are both hereby incorporated by reference).

In some embodiments, the biradicle —X—Y— is —O—CR$^a$R$^b$—, wherein in neither R$^a$ or R$^b$ is hydrogen, W is O, and all of R$^1$, R$^2$, R$^3$, R$^5$ and R$^{5*}$ are all hydrogen. In some embodiments, R$^a$ and R$^b$ are both methyl. Such 6' di-substituted LNA nucleosides are disclosed in WO 2009006478 which is hereby incorporated by reference.

In some embodiments, the biradicle —X—Y— is —S—CHR$^a$—, W is O, and all of R$^1$, R$^2$, R$^3$, R$^5$ and R$^{5*}$ are all hydrogen. Such 6' substituted thio LNA nucleosides are disclosed in WO11156202 which is hereby incorporated by reference. In some 6' substituted thio LNA embodiments R$^a$ is methyl.

In some embodiments, the biradicle —X—Y— is —C(=CH$_2$)—C(R$^a$R$^b$)—, such as —C(=CH$_2$)—CH$_2$—, or —C(=CH$_2$)—CH(CH$_3$)—W is O, and all of R$^1$, R$^2$, R$^3$, R$^5$ and R$^{5*}$ are all hydrogen. Such vinyl carbo LNA nucleosides are disclosed in WO08154401 and WO09067647 which are both hereby incorporated by reference.

In some embodiments the biradicle —X—Y— is —N(—OR$^a$)—, W is O, and all of R$^1$, R$^2$, R$^3$, R$^5$ and R$^{5*}$ are all hydrogen. In some embodiments R$^a$ is C$_{1-6}$ alkyl such as methyl. Such LNA nucleosides are also known as N substituted LNAs and are disclosed in WO2008/150729 which is hereby incorporated by reference. In some embodiments, the biradicle —X—Y— together designate the bivalent linker group —O—NR$^a$—CH$_3$— (Seth at al., 2010, J. Org. Chem). In some embodiments the biradicle —X—Y— is —N(R$^a$)—, W is O, and all of R$^1$, R$^2$, R$^3$, R$^5$ and R$^{5*}$ are all hydrogen. In some embodiments R$^a$ is C$_{1-6}$ alkyl such as methyl.

In some embodiments, one or both of R$^5$ and R$^{5*}$ is hydrogen and, when substituted the other of R$^5$ and R$^{5*}$ is C$_{1-6}$ alkyl such as methyl. In such an embodiment, R$^1$, R$^2$, R$^3$, may all be hydrogen, and the biradicle —X—Y— may be selected from —O—CH2- or —O—C(HCR$^a$)—, such as —O—C(HCH3)-.

In some embodiments, the biradicle is —CR$^a$R$^b$—O—CR$^a$R$^b$—, such as CH$_2$—O—CH$_2$—, W is O and all of R$^1$, R$^2$, R$^3$, R$^5$ and R$^{5*}$ are all hydrogen. In some embodiments R$^a$ is C$_{1-6}$ alkyl such as methyl. Such LNA nucleosides are also known as conformationally restricted nucleotides (CRNs) and are disclosed in WO2013036868 which is hereby incorporated by reference.

In some embodiments, the biradicle is —O—CR$^a$R$^b$—O—CR$^a$R$^b$—, such as O—CH$_2$—O—CH$_2$—, W is O and all of R$^1$, R$^2$, R$^3$, R$^5$ and R$^{5*}$ are all hydrogen. In some embodiments R$^a$ is C$_{1-6}$ alkyl such as methyl. Such LNA nucleosides are also known as COC nucleotides and are disclosed in Mitsuoka et al., Nucleic Acids Research 2009 37(4), 1225-1238, which is hereby incorporated by reference.

It will be recognized than, unless specified, the LNA nucleosides may be in the beta-D or alpha-L stereoisoform.

Certain examples of LNA nucleosides are presented in Scheme 1.

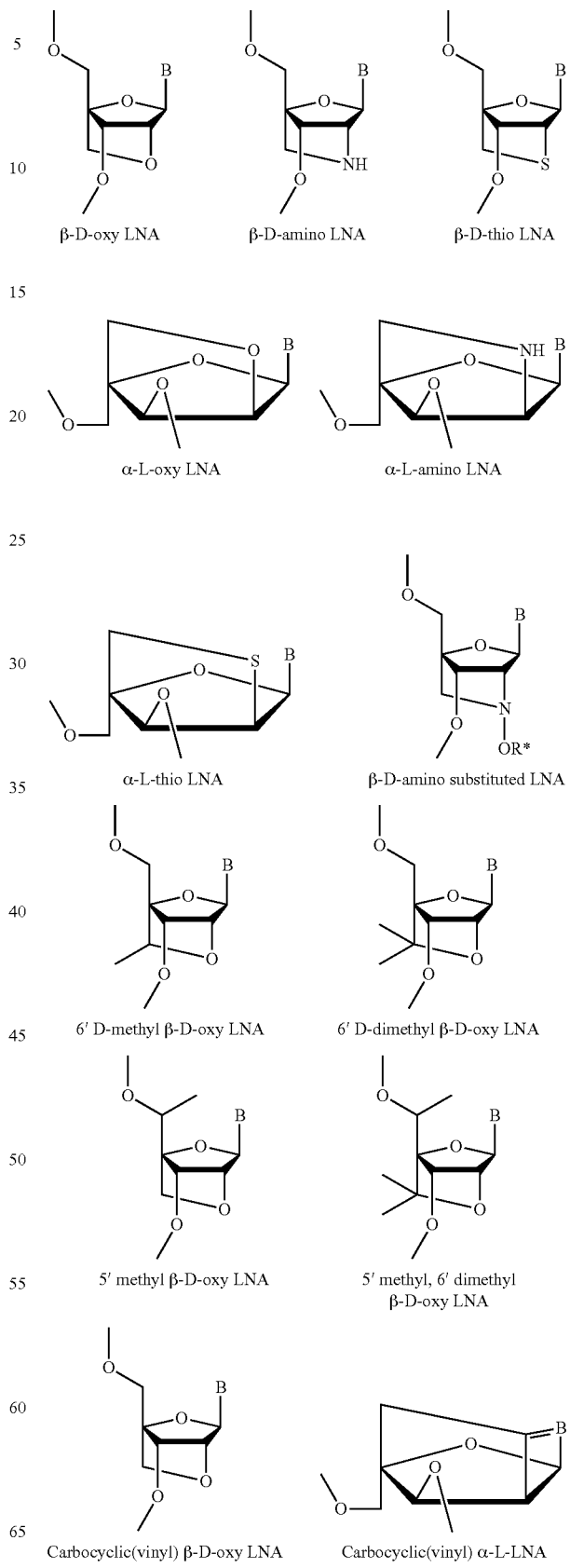

Scheme 1

β-D-oxy LNA

β-D-amino LNA

β-D-thio LNA

α-L-oxy LNA

α-L-amino LNA

α-L-thio LNA

β-D-amino substituted LNA

6' D-methyl β-D-oxy LNA

6' D-dimethyl β-D-oxy LNA

5' methyl β-D-oxy LNA

5' methyl, 6' dimethyl β-D-oxy LNA

Carbocyclic(vinyl) β-D-oxy LNA

Carbocyclic(vinyl) α-L-LNA

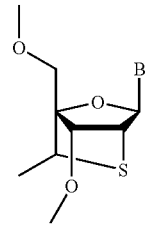
6' methyl thio β-D LNA

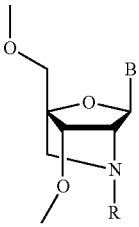
Substituted β-D amino LNA

As illustrated in the examples, in preferred embodiments of the invention the LNA nucleosides in the oligonucleotides are beta-D-oxy-LNA nucleosides.

Nuclease Mediated Degradation

Nuclease mediated degradation refers to an oligonucleotide capable of mediating degradation of a complementary nucleotide sequence when forming a duplex with such a sequence.

In some embodiments, the oligonucleotide may function via nuclease mediated degradation of the target nucleic acid, where the oligonucleotides of the invention are capable of recruiting a nuclease, particularly and endonuclease, preferably endoribonuclease (RNase), such as RNase H. Examples of oligonucleotide designs which operate via nuclease mediated mechanisms are oligonucleotides which typically comprise a region of at least 5 or 6 DNA nucleosides and are flanked on one side or both sides by affinity enhancing nucleosides, for example gapmers, headmers and tailmers.

RNase H Activity and Recruitment

The RNase H activity of an antisense oligonucleotide refers to its ability to recruit RNase H when in a duplex with a complementary RNA molecule. WO01/23613 provides in vitro methods for determining RNaseH activity, which may be used to determine the ability to recruit RNaseH. Typically an oligonucleotide is deemed capable of recruiting RNase H if it, when provided with a complementary target nucleic acid sequence, has an initial rate, as measured in pmol/l/min, of at least 10% or more than 20% of the of the initial rate determined when using a oligonucleotide having the same base sequence as the modified oligonucleotide being tested, but containing only DNA monomers, with phosphorothioate linkages between all monomers in the oligonucleotide, and using the methodology provided by Example 91-95 of WO01/23613 (hereby incorporated by reference).

Gapmer

The term gapmer as used herein refers to an antisense oligonucleotide which comprises a region of RNase H recruiting oligonucleotides (gap) which is flanked 5' and 3' by one or more affinity enhancing modified nucleosides (flanks). Various gapmer designs are described herein. Headmers and tailmers are oligonucleotides capable of recruiting RNase H where one of the flanks is missing, i.e. only one of the ends of the oligonucleotide comprises affinity enhancing modified nucleosides. For headmers the 3' flank is missing (i.e. the 5' flanc comprise affinity enhancing modified nucleosides) and for tailmers the 5' flank is missing (i.e. the 3' flank comprises affinity enhancing modified nucleosides).

LNA Gapmer

The term LNA gapmer is a gapmer oligonucleotide wherein at least one of the affinity enhancing modified nucleosides is an LNA nucleoside.

Mixed Wing Gapmer

The term mixed wing gapmer refers to a LNA gapmer wherein the flank regions comprise at least one LNA nucleoside and at least one non-LNA modified nucleoside, such as at least one 2' substituted modified nucleoside, such as, for example, 2'-O-alkyl-RNA, 2'-O-methyl-RNA, 2'-alkoxy-RNA, 2'-O-methoxyethyl-RNA (MOE), 2'-amino-DNA, 2'-Fluoro-RNA, and 2'-F-ANA nucleoside(s). In some embodiments the mixed wing gapmer has one flank which comprises LNA nucleosides (e.g. 5' or 3') and the other flank (3' or 5' respectfully) comprises 2' substituted modified nucleoside(s).

Conjugate

The term conjugate as used herein refers to an oligonucleotide which is covalently linked to a non-nucleotide moiety (conjugate moiety or region C or third region).

Conjugation of the oligonucleotide of the invention to one or more non-nucleotide moieties may improve the pharmacology of the oligonucleotide, e.g. by affecting the activity, cellular distribution, cellular uptake or stability of the oligonucleotide. In some embodiments the conjugate moiety modify or enhance the pharmacokinetic properties of the oligonucleotide by improving cellular distribution, bioavailability, metabolism, excretion, permeability, and/or cellular uptake of the oligonucleotide. In particular the conjugate may target the oligonucleotide to a specific organ, tissue or cell type and thereby enhance the effectiveness of the oligonucleotide in that organ, tissue or cell type. A the same time the conjugate may serve to reduce activity of the oligonucleotide in non-target cell types, tissues or organs, e.g. off target activity or activity in non-target cell types, tissues or organs. WO 93/07883 and WO 2013/033230 provides suitable conjugate moieties, which are hereby incorporated by reference. WO 2012/143379 provides a method of delivering a drug across the blood-brain-barrier by conjugation to an antibody fragment with affinity to the transferrin receptor, which are hereby incorporated by reference.

Oligonucleotide conjugates and their synthesis has also been reported in comprehensive reviews by Manoharan in Antisense Drug Technology, Principles, Strategies, and Applications, S. T. Crooke, ed., Ch. 16, Marcel Dekker, Inc., 2001 and Manoharan, Antisense and Nucleic Acid Drug Development, 2002, 12, 103, each of which is incorporated herein by reference in its entirety.

In an embodiment, the non-nucleotide moiety (conjugate moiety) is selected from the group consisting of carbohydrates, cell surface receptor ligands, drug substances, hormones, lipophilic substances, polymers, proteins, peptides, toxins (e.g. bacterial toxins), vitamins, viral proteins (e.g. capsids) or combinations thereof. In some embodiments the non-nucleotide moiety an antibody or antibody fragment, such as an antibody or antibody fragment that facilitates delivery across the blood-brain-barrier, in particular an antibody or antibody fragment targeting the transferrin receptor.

Linkers

A linkage or linker is a connection between two atoms that links one chemical group or segment of interest to another chemical group or segment of interest via one or more covalent bonds. Conjugate moieties can be attached to the oligonucleotide directly or through a linking moiety (e.g. linker or tether). Linkers serve to covalently connect a third region, e.g. a conjugate moiety (Region C), to a first region, e.g. an oligonucleotide (region A).

In some embodiments of the invention the conjugate or oligonucleotide conjugate of the invention may optionally, comprise a linker region (second region or region B and/or region Y) which is positioned between the oligonucleotide (region A or first region) and the conjugate moiety (region C or third region).

Region B refers to biocleavable linkers comprising or consisting of a physiologically labile bond that is cleavable under conditions normally encountered or analogous to those encountered within a mammalian body. Conditions under which physiologically labile linkers undergo chemical transformation (e.g., cleavage) include chemical conditions such as pH, temperature, oxidative or reductive conditions or agents, and salt concentration found in or analogous to those encountered in mammalian cells. Mammalian intracellular conditions also include the presence of enzymatic activity normally present in a mammalian cell such as from proteolytic enzymes or hydrolytic enzymes or nucleases. In one embodiment the biocleavable linker is susceptible to S1 nuclease cleavage. In a preferred embodiment the nuclease susceptible linker comprises between 1 and 10 nucleosides, such as 1, 2, 3, 4, 5, 6, 7, 8, 9 or 10 nucleosides, more preferably between 2 and 6 nucleosides and most preferably between 2 and 4 linked nucleosides comprising at least two consecutive phosphodiester linkages, such as at least 3 or 4 or 5 consecutive phosphodiester linkages. Preferably the nucleosides are DNA or RNA. Phosphodiester containing biocleavable linkers are described in more detail in WO 2014/076195 (hereby incorporated by reference).

Region Y refers to linkers that are not necessarily biocleavable but primarily serve to covalently connect a conjugate moiety (region C or third region), to an oligonucleotide (region A or first region). The region Y linkers may comprise a chain structure or an oligomer of repeating units such as ethylene glycol, amino acid units or amino alkyl groups The oligonucleotide conjugates of the present invention can be constructed of the following regional elements A-C, A-B-C, A-B-Y-C, A-Y-B-C or A-Y-C. In some embodiments the linker (region Y) is an amino alkyl, such as a C2-C36 amino alkyl group, including, for example C6 to C12 amino alkyl groups. In a preferred embodiment the linker (region Y) is a C6 amino alkyl group.

Control

By the term "control" when used in relation to measurements of the effect of an oligonucleotide it is generally understood that the control is an untreated individual or target cell or a individual or target cell treated with a non-targeting oligonucleotide (mock). It may however also be an individual treated with the standard of care.

Treatment

The term 'treatment' as used herein refers to both treatment of an existing disease (e.g. a disease or disorder as herein referred to), or prevention of a disease, i.e. prophylaxis. It will therefore be recognized that treatment as referred to herein may, in some embodiments, be prophylactic.

DETAILED DESCRIPTION OF THE INVENTION

The Target

An aspect of the invention is to modulate the level of pig, primate or human UBE3A protein expression, in particular to increase the expression of paternal UBE3A expression in neuronal cells, in particular in human neuronal cells. The human UBE3A protein exists in several isoforms which are listed under Uniprot nr. Q05086. Several mutations in the maternal UBE3A gene can results in Angelman syndrome.

The target nucleic acid for the oligonucleotides of the invention is RNA, in particular a long non-coding RNA. The long non-coding RNA which is targeted by the oligonucleotides of the present invention is human SNHG14 (also known as UBE3A-ATS with Ensembl entry number ENSG00000224078, version GRCh38.p2). In particular the target nucleic acid is the region downstream of SNORD109B corresponding to position 25278410 to 25419462 on chromosome 15 (SEQ ID NO: 1). In Rhesus monkey (*Macaca mulatta*) the UBE3A suppressor is defined as region downstream of SNORD109A corresponding to position 4222848 to U.S. Pat. No. 4,373,084 (forward strand) on chromosome 7 using the Ensembl assembly MMUL 1.0 (SEQ ID NO: 2).

In some embodiments, the target nucleic acid is SEQ ID NO: 1, or naturally occurring variants thereof.

In certain embodiments the target nucleic acid correspond to regions which are conserved between human (SEQ ID NO: 1) and Rhesus monkey (SEQ ID NO: 2). In certain embodiments target nucleic acid correspond to regions which are conserved between human (SEQ ID NO:1), Rhesus monkey (SEQ ID NO: 2) and mouse (SEQ ID NO: 3).

In certain embodiments the target nucleic acid is the region that is antisense to the UBE3A pre-mRNA, this region corresponds to position 55319 to 141053 of SEQ ID NO: 1.

In certain embodiments the target nucleic acid is the region that is downstream of SNORD109B and upstream of the region that is antisense to the UBE3A pre-mRNA, this region corresponds to position 1 to 55319 of SEQ ID NO: 1.

In some embodiments, the target nucleic acid is present in a cell, such as a mammalian cell in particular a human cell in vitro or in vivo (the target cell). In certain embodiments the target cell is a neuron, preferably a human neuronal cell.

The target sequence may be a sub-sequence of the target nucleic acid. In some embodiments the oligonucleotide targets sub-sequence selected from the group consisting of the antisense region of exon 9, exon10, exon13, exon14, intron 14, exon 15, intron15 and exon 16 of UBE3A. In some embodiments the oligonucleotide or contiguous nucleotide sequence hybridize or is complementary to a single stranded nucleic acid molecule selected from the group consisting of positions: 55319-76274, 77483-77573, 92157-93403 and 97056-97354 of SEQ ID NO: 1. In some embodiments the oligonucleotide or contiguous nucleotide sequence hybridize or is complementary to a single stranded nucleic acid molecule selected from the group consisting of positions: 60821-60849, 77567-77583, 92323-92339 and 97156-97172 of SEQ ID NO: 1.

In some embodiments the target nucleic acid is a region corresponding to positions 9200-9250 of SEQ ID NO: 1.

In some embodiments the target nucleic acid is a region corresponding to positions 11505-11555 of SEQ ID NO: 1.

In some embodiments the target nucleic acid is a region corresponding to positions 15100-15150 of SEQ ID NO: 1.

In some embodiments the target nucleic acid is a region corresponding to positions 30590-30740 of SEQ ID NO: 1.

In some embodiments the target nucleic acid is a region corresponding to positions 46380-46430 of SEQ ID NO: 1.

The Oligonucleotides of the Invention

The invention relates to oligonucleotides capable of modulating expression of paternal UBE3A, in particular induction or up-regulation of paternally expressed UBE3A in neuronal cells. The modulation is achieved by hybridizing to a target nucleic acid located on the long non-coding RNA SNHG14 transcript downstream of SNORD109B. In certain embodiments the oligonucleotide of the invention hybridizes to a sub-sequence of the target nucleic acid of SEQ ID NO: 1 with a ΔG° below −10 kcal, such as with a ΔG° between −10 to −60 kcal, such as −12 to −40, such as from −15 to −30 kcal or −16 to −27 kcal such as −18 to −25 kcal.

The oligonucleotide of the invention is an antisense oligonucleotide which targets the pig, rhesus monkey and/or human SNHG14 transcript downstream of SNORD109B.

In some embodiments the antisense oligonucleotide of the invention is capable of modulating the expression of the target by removing, interfering with or decreasing the suppressor of the target. Preferably, the oligonucleotides of the invention induce UBE3A expression in a cell, in particular paternal UBE3A expression in a neuron, by degradation or removal of the SNHG14 transcript downstream of SNORD109B. In some embodiments the oligonucleotides of the invention are capable of increasing the expression of UBE3A by least 20% compared to the expression level of UBE3A in a neuronal cell treated with saline or a non-targeting oligonucleotide, more preferably by at least 30%, 35%, 40%, 45%, 50%, 55%, 60%, 80%, 100%, 120%, 150%, 160%, 170%, 180%, 190%, 200%, 210%, 220%, 230%, 240% or 250% compared to the expression level of UBE3A in a neuronal cell treated with saline or a non-targeting oligonucleotide. In additional embodiments the oligonucleotides of the invention are capable of decreasing the level of the SNHG14 transcript downstream of SNORD109B (in particular the part of the transcript that is antisense to the UBE3A pre-mRNA region) by at least 20% compared to the level of the SNHG14 transcript downstream of SNORD109B in a neuronal cell treated with saline or a non-targeting oligonucleotide, more preferably by at least 30%, 40%, 50%, 60%, 70%, 80%, 90% or 95% compared to the level of the SNHG14 transcript downstream of SNORD109B in a neuronal cell treated with saline or a non-targeting oligonucleotide, without reducing SNORD115 levels by more than 0%, 1%, 2%, 3%, 4%, 5%, 6%, 7%, 8%, 9%, 10%, 12%, 14%, 16%, 18%, 20%, 25% or 30% compared to the level of SNORD115 in a cell treated with saline or a non-targeting oligonucleotide. SNRPN and SNORD116 transcripts are located upstream from the SNORD115 transcript consequently if the SNORD115 transcript is not reduced by the oligonucleotide it is highly likely that the SNRPN and SNORD116 transcripts are also not reduced. In a further embodiment SNRPN and SNORD116 transcripts levels are not reduced by more than 0%, 1%, 2%, 3%, 4%, 5%, 6%, 7%, 8%, 9%, 10%, 12%, 14%, 16%, 18%, 20%, 25% or 30% compared to the level of SNRPN and SNORD116 in a cell treated with saline or a non-targeting oligonucleotide.

The target modulation is triggered by the hybridization between a contiguous nucleotide sequence of the oligonucleotide and the target nucleic acid. In some embodiments the oligonucleotide of the invention comprises mismatches between the oligonucleotide and the target nucleic acid. Despite mismatches hybridization to the target nucleic acid may still be sufficient to show a desired modulation of UBE3A expression. Reduced binding affinity resulting from mismatches may advantageously be compensated by increased number of nucleotides in the oligonucleotide and/or an increased number of modified nucleosides capable of increasing the binding affinity to the target, such as 2' modified nucleosides, including LNA, present within the oligonucleotide sequence.

An aspect of the present invention relates to an antisense oligonucleotide which comprises a contiguous nucleotide sequence of 10 to 30 nucleotides in length with at least 90%, such as 95%, such as 98% such as 100% complementarity to position 25278410 to 25419462 on human chromosome 15.

In some embodiments, the oligonucleotide comprises a contiguous sequence which is at least 90% complementary, such as at least 91%, such as at least 92%, such as at least 93%, such as at least 94%, such as at least 95%, such as at least 96%, such as at least 97%, such as at least 98%, or 100% complementary with a region of the target nucleic acid shown as SEQ ID NO: 1, 2 or 3.

In a preferred embodiment the oligonucleotide of the invention, or contiguous nucleotide sequence thereof is fully complementary (100% complementary) to a region of the target nucleic acid shown as SEQ ID NO: 1, or in some embodiments may comprise one or two mismatches between the oligonucleotide and the target nucleic acid.

In some embodiments the oligonucleotide sequence is 100% complementary to a corresponding target nucleic acid region present in SEQ ID NO: 1 and SEQ ID NO: 2. In some embodiments the oligonucleotide sequence is 100% complementary to a corresponding target nucleic acid region present SEQ ID NO: 1, 2 and 3.

In some embodiments, the oligonucleotide comprises a contiguous nucleotide sequence of 10 to 30 nucleotides in length with at least 90% complementary, such as 100% complementarity, to a corresponding target nucleic acid region present in SEQ ID NO: 1, wherein the target nucleic acid region is selected from the group consisting of region A1 to A3649 in table 1

TABLE 1

Regions of SEQ ID NO 1 which may be targeted using oligonucleotide of the invention

| Reg. A | Position in SEQ ID NO 1 from | to | Length |
|---|---|---|---|
| 1 | 10 | 75 | 66 |
| 2 | 77 | 91 | 15 |
| 3 | 93 | 108 | 16 |
| 4 | 168 | 213 | 46 |
| 5 | 217 | 282 | 66 |
| 6 | 284 | 299 | 16 |
| 7 | 301 | 328 | 28 |
| 8 | 330 | 344 | 15 |
| 9 | 361 | 400 | 40 |
| 10 | 415 | 447 | 33 |
| 11 | 449 | 470 | 22 |
| 12 | 472 | 487 | 16 |
| 13 | 489 | 521 | 33 |
| 14 | 523 | 540 | 18 |
| 15 | 551 | 570 | 20 |
| 16 | 590 | 638 | 49 |
| 17 | 652 | 670 | 19 |
| 18 | 672 | 733 | 62 |
| 19 | 735 | 756 | 22 |
| 20 | 758 | 773 | 16 |
| 21 | 781 | 829 | 49 |
| 22 | 831 | 870 | 40 |
| 23 | 882 | 903 | 22 |
| 24 | 918 | 949 | 32 |
| 25 | 961 | 990 | 30 |
| 26 | 1007 | 1021 | 15 |
| 27 | 1019 | 1050 | 32 |
| 28 | 1052 | 1090 | 39 |
| 29 | 1092 | 1139 | 48 |
| 30 | 1147 | 1179 | 33 |
| 31 | 1175 | 1212 | 38 |
| 32 | 1220 | 1242 | 23 |
| 33 | 1245 | 1259 | 15 |
| 34 | 1265 | 1278 | 14 |

TABLE 1-continued

Regions of SEQ ID NO 1 which may be targeted using oligonucleotide of the invention

| Reg. A | Position in SEQ ID NO 1 from | to | Length |
|---|---|---|---|
| 35 | 1285 | 1323 | 39 |
| 36 | 1317 | 1330 | 14 |
| 37 | 1337 | 1355 | 19 |
| 38 | 1357 | 1403 | 47 |
| 39 | 1405 | 1421 | 17 |
| 40 | 1423 | 1481 | 59 |
| 41 | 1486 | 1515 | 30 |
| 42 | 1521 | 1581 | 61 |
| 43 | 1611 | 1633 | 23 |
| 44 | 1631 | 1644 | 14 |
| 45 | 1635 | 1663 | 29 |
| 46 | 1669 | 1684 | 16 |
| 47 | 1685 | 1709 | 25 |
| 48 | 1711 | 1724 | 14 |
| 49 | 1726 | 1746 | 21 |
| 50 | 1754 | 1808 | 55 |
| 51 | 1819 | 1860 | 42 |
| 52 | 1862 | 1878 | 17 |
| 53 | 1896 | 1910 | 15 |
| 54 | 1923 | 1944 | 22 |
| 55 | 1946 | 1987 | 42 |
| 56 | 1985 | 2051 | 67 |
| 57 | 2053 | 2082 | 30 |
| 58 | 2088 | 2104 | 17 |
| 59 | 2106 | 2125 | 20 |
| 60 | 2132 | 2207 | 76 |
| 61 | 2209 | 2234 | 26 |
| 62 | 2247 | 2261 | 15 |
| 63 | 2263 | 2286 | 24 |
| 64 | 2290 | 2306 | 17 |
| 65 | 2308 | 2329 | 22 |
| 66 | 2347 | 2391 | 45 |
| 67 | 2398 | 2431 | 34 |
| 68 | 2447 | 2468 | 22 |
| 69 | 2470 | 2555 | 86 |
| 70 | 2565 | 2579 | 15 |
| 71 | 2579 | 2592 | 14 |
| 72 | 2589 | 2605 | 17 |
| 73 | 2594 | 2657 | 64 |
| 74 | 2672 | 2687 | 16 |
| 75 | 2692 | 2705 | 14 |
| 76 | 2703 | 2721 | 19 |
| 77 | 2770 | 2824 | 55 |
| 78 | 2826 | 2841 | 16 |
| 79 | 2838 | 2851 | 14 |
| 80 | 2843 | 2889 | 47 |
| 81 | 2896 | 2930 | 35 |
| 82 | 2930 | 2967 | 38 |
| 83 | 2965 | 2988 | 24 |
| 84 | 2984 | 3028 | 45 |
| 85 | 3024 | 3080 | 57 |
| 86 | 3081 | 3135 | 55 |
| 87 | 3140 | 3176 | 37 |
| 88 | 3168 | 3189 | 22 |
| 89 | 3197 | 3222 | 26 |
| 90 | 3212 | 3226 | 15 |
| 91 | 3221 | 3248 | 28 |
| 92 | 3243 | 3256 | 14 |
| 93 | 3250 | 3264 | 15 |
| 94 | 3266 | 3292 | 27 |
| 95 | 3326 | 3343 | 18 |
| 96 | 3345 | 3391 | 47 |
| 97 | 3400 | 3422 | 23 |
| 98 | 3424 | 3441 | 18 |
| 99 | 3434 | 3447 | 14 |
| 100 | 3443 | 3503 | 61 |
| 101 | 3495 | 3508 | 14 |
| 102 | 3505 | 3558 | 54 |
| 103 | 3589 | 3609 | 21 |
| 104 | 3611 | 3641 | 31 |
| 105 | 3662 | 3696 | 35 |
| 106 | 3698 | 3719 | 22 |
| 107 | 3723 | 3790 | 68 |
| 108 | 3810 | 3854 | 45 |
| 109 | 3858 | 3873 | 16 |
| 110 | 3902 | 3968 | 67 |
| 111 | 3971 | 4009 | 39 |
| 112 | 4005 | 4018 | 14 |
| 113 | 4011 | 4030 | 20 |
| 114 | 4032 | 4077 | 46 |
| 115 | 4082 | 4114 | 33 |
| 116 | 4123 | 4140 | 18 |
| 117 | 4150 | 4164 | 15 |
| 118 | 4166 | 4183 | 18 |
| 119 | 4185 | 4243 | 59 |
| 120 | 4248 | 4268 | 21 |
| 121 | 4284 | 4313 | 30 |
| 122 | 4317 | 4348 | 32 |
| 123 | 4364 | 4471 | 108 |
| 124 | 4473 | 4491 | 19 |
| 125 | 4494 | 4519 | 26 |
| 126 | 4521 | 4535 | 15 |
| 127 | 4545 | 4560 | 16 |
| 128 | 4567 | 4606 | 40 |
| 129 | 4616 | 4714 | 99 |
| 130 | 4725 | 4755 | 31 |
| 131 | 4757 | 4786 | 30 |
| 132 | 4788 | 4852 | 65 |
| 133 | 4856 | 4910 | 55 |
| 134 | 4912 | 4935 | 24 |
| 135 | 4937 | 4970 | 34 |
| 136 | 4972 | 5010 | 39 |
| 137 | 5058 | 5078 | 21 |
| 138 | 5080 | 5116 | 37 |
| 139 | 5110 | 5124 | 15 |
| 140 | 5135 | 5166 | 32 |
| 141 | 5168 | 5201 | 34 |
| 142 | 5203 | 5247 | 45 |
| 143 | 5261 | 5276 | 16 |
| 144 | 5278 | 5293 | 16 |
| 145 | 5314 | 5330 | 17 |
| 146 | 5332 | 5382 | 51 |
| 147 | 5398 | 5414 | 17 |
| 148 | 5427 | 5456 | 30 |
| 149 | 5458 | 5471 | 14 |
| 150 | 5487 | 5500 | 14 |
| 151 | 5506 | 5545 | 40 |
| 152 | 5561 | 5577 | 17 |
| 153 | 5580 | 5617 | 38 |
| 154 | 5607 | 5620 | 14 |
| 155 | 5619 | 5642 | 24 |
| 156 | 5644 | 5683 | 40 |
| 157 | 5685 | 5698 | 14 |
| 158 | 5713 | 5759 | 47 |
| 159 | 5756 | 5769 | 14 |
| 160 | 5784 | 5803 | 20 |
| 161 | 5801 | 5865 | 65 |
| 162 | 5873 | 5905 | 33 |
| 163 | 5907 | 5937 | 31 |
| 164 | 5939 | 5985 | 47 |
| 165 | 5987 | 6017 | 31 |
| 166 | 6016 | 6039 | 24 |
| 167 | 6028 | 6092 | 65 |
| 168 | 6102 | 6127 | 26 |
| 169 | 6127 | 6152 | 26 |
| 170 | 6151 | 6171 | 21 |
| 171 | 6178 | 6206 | 29 |
| 172 | 6217 | 6234 | 18 |
| 173 | 6224 | 6270 | 47 |
| 174 | 6272 | 6289 | 18 |
| 175 | 6291 | 6310 | 20 |
| 176 | 6312 | 6357 | 46 |
| 177 | 6367 | 6389 | 23 |
| 178 | 6396 | 6422 | 27 |

TABLE 1-continued

Regions of SEQ ID NO 1 which may be targeted using oligonucleotide of the invention

| Reg. A | Position in SEQ ID NO 1 from | to | Length |
|---|---|---|---|
| 179 | 6440 | 6454 | 15 |
| 180 | 6456 | 6482 | 27 |
| 181 | 6484 | 6513 | 30 |
| 182 | 6505 | 6519 | 15 |
| 183 | 6518 | 6553 | 36 |
| 184 | 6552 | 6565 | 14 |
| 185 | 6557 | 6590 | 34 |
| 186 | 6596 | 6628 | 33 |
| 187 | 6640 | 6675 | 36 |
| 188 | 6686 | 6711 | 26 |
| 189 | 6714 | 6746 | 33 |
| 190 | 6781 | 6818 | 38 |
| 191 | 6832 | 6885 | 54 |
| 192 | 6889 | 6912 | 24 |
| 193 | 6920 | 6938 | 19 |
| 194 | 6940 | 6960 | 21 |
| 195 | 6954 | 6976 | 23 |
| 196 | 6998 | 7033 | 36 |
| 197 | 7035 | 7061 | 27 |
| 198 | 7071 | 7143 | 73 |
| 199 | 7159 | 7214 | 56 |
| 200 | 7253 | 7266 | 14 |
| 201 | 7268 | 7281 | 14 |
| 202 | 7283 | 7328 | 46 |
| 203 | 7329 | 7343 | 15 |
| 204 | 7338 | 7355 | 18 |
| 205 | 7345 | 7374 | 30 |
| 206 | 7374 | 7387 | 14 |
| 207 | 7383 | 7396 | 14 |
| 208 | 7389 | 7405 | 17 |
| 209 | 7399 | 7413 | 15 |
| 210 | 7420 | 7437 | 18 |
| 211 | 7427 | 7448 | 22 |
| 212 | 7450 | 7503 | 54 |
| 213 | 7495 | 7565 | 71 |
| 214 | 7561 | 7616 | 56 |
| 215 | 7618 | 7703 | 86 |
| 216 | 7717 | 7772 | 56 |
| 217 | 7776 | 7838 | 63 |
| 218 | 7852 | 7869 | 18 |
| 219 | 7882 | 7910 | 29 |
| 220 | 7919 | 7942 | 24 |
| 221 | 7944 | 7957 | 14 |
| 222 | 7959 | 7977 | 19 |
| 223 | 7979 | 7996 | 18 |
| 224 | 7998 | 8014 | 17 |
| 225 | 8030 | 8046 | 17 |
| 226 | 8059 | 8092 | 34 |
| 227 | 8100 | 8113 | 14 |
| 228 | 8115 | 8141 | 27 |
| 229 | 8143 | 8175 | 33 |
| 230 | 8179 | 8192 | 14 |
| 231 | 8187 | 8208 | 22 |
| 232 | 8205 | 8219 | 15 |
| 233 | 8210 | 8229 | 20 |
| 234 | 8231 | 8252 | 22 |
| 235 | 8254 | 8298 | 45 |
| 236 | 8302 | 8316 | 15 |
| 237 | 8306 | 8329 | 24 |
| 238 | 8331 | 8357 | 27 |
| 239 | 8400 | 8443 | 44 |
| 240 | 8443 | 8456 | 14 |
| 241 | 8445 | 8460 | 16 |
| 242 | 8472 | 8505 | 34 |
| 243 | 8494 | 8507 | 14 |
| 244 | 8554 | 8569 | 16 |
| 245 | 8571 | 8653 | 83 |
| 246 | 8659 | 8673 | 15 |
| 247 | 8675 | 8694 | 20 |
| 248 | 8696 | 8713 | 18 |
| 249 | 8736 | 8844 | 109 |
| 250 | 8847 | 8909 | 63 |
| 251 | 8915 | 8959 | 45 |
| 252 | 8961 | 8975 | 15 |
| 253 | 8993 | 9009 | 17 |
| 254 | 9024 | 9048 | 25 |
| 255 | 9050 | 9063 | 14 |
| 256 | 9089 | 9120 | 32 |
| 257 | 9127 | 9166 | 40 |
| 258 | 9191 | 9249 | 59 |
| 259 | 9257 | 9285 | 29 |
| 260 | 9288 | 9302 | 15 |
| 261 | 9331 | 9397 | 67 |
| 262 | 9399 | 9438 | 40 |
| 263 | 9437 | 9455 | 19 |
| 264 | 9483 | 9505 | 23 |
| 265 | 9507 | 9526 | 20 |
| 266 | 9583 | 9598 | 16 |
| 267 | 9600 | 9613 | 14 |
| 268 | 9628 | 9641 | 14 |
| 269 | 9653 | 9674 | 22 |
| 270 | 9676 | 9690 | 15 |
| 271 | 9745 | 9758 | 14 |
| 272 | 9752 | 9780 | 29 |
| 273 | 9796 | 9809 | 14 |
| 274 | 9811 | 9825 | 15 |
| 275 | 9832 | 9853 | 22 |
| 276 | 9877 | 9899 | 23 |
| 277 | 9901 | 9932 | 32 |
| 278 | 10000 | 10016 | 17 |
| 279 | 10029 | 10049 | 21 |
| 280 | 10051 | 10071 | 21 |
| 281 | 10089 | 10120 | 32 |
| 282 | 10111 | 10127 | 17 |
| 283 | 10122 | 10203 | 82 |
| 284 | 10211 | 10237 | 27 |
| 285 | 10239 | 10256 | 18 |
| 286 | 10258 | 10285 | 28 |
| 287 | 10287 | 10304 | 18 |
| 288 | 10306 | 10350 | 45 |
| 289 | 10352 | 10375 | 24 |
| 290 | 10381 | 10402 | 22 |
| 291 | 10412 | 10470 | 59 |
| 292 | 10474 | 10488 | 15 |
| 293 | 10508 | 10557 | 50 |
| 294 | 10565 | 10630 | 66 |
| 295 | 10632 | 10674 | 43 |
| 296 | 10698 | 10711 | 14 |
| 297 | 10701 | 10714 | 14 |
| 298 | 10704 | 10718 | 15 |
| 299 | 10720 | 10740 | 21 |
| 300 | 10742 | 10785 | 44 |
| 301 | 10786 | 10809 | 24 |
| 302 | 10811 | 10829 | 19 |
| 303 | 10832 | 10867 | 36 |
| 304 | 10869 | 10930 | 62 |
| 305 | 10932 | 10950 | 19 |
| 306 | 10959 | 10996 | 38 |
| 307 | 10998 | 11028 | 31 |
| 308 | 11037 | 11077 | 41 |
| 309 | 11079 | 11105 | 27 |
| 310 | 11115 | 11132 | 18 |
| 311 | 11134 | 11154 | 21 |
| 312 | 11156 | 11196 | 41 |
| 313 | 11206 | 11239 | 34 |
| 314 | 11241 | 11255 | 15 |
| 315 | 11266 | 11287 | 22 |
| 316 | 11299 | 11329 | 31 |
| 317 | 11331 | 11352 | 22 |
| 318 | 11358 | 11403 | 46 |
| 319 | 11405 | 11432 | 28 |
| 320 | 11434 | 11480 | 47 |
| 321 | 11482 | 11535 | 54 |
| 322 | 11539 | 11573 | 35 |

TABLE 1-continued

Regions of SEQ ID NO 1 which may be targeted using oligonucleotide of the invention

| Reg. A | Position in SEQ ID NO 1 from | to | Length |
|---|---|---|---|
| 323 | 11584 | 11732 | 149 |
| 324 | 11731 | 11763 | 33 |
| 325 | 11765 | 11782 | 18 |
| 326 | 11784 | 11813 | 30 |
| 327 | 11815 | 11829 | 15 |
| 328 | 11831 | 11852 | 22 |
| 329 | 11854 | 11871 | 18 |
| 330 | 11866 | 11895 | 30 |
| 331 | 11930 | 11943 | 14 |
| 332 | 11975 | 12007 | 33 |
| 333 | 11996 | 12012 | 17 |
| 334 | 12017 | 12040 | 24 |
| 335 | 12050 | 12083 | 34 |
| 336 | 12088 | 12111 | 24 |
| 337 | 12133 | 12151 | 19 |
| 338 | 12161 | 12174 | 14 |
| 339 | 12179 | 12225 | 47 |
| 340 | 12238 | 12256 | 19 |
| 341 | 12265 | 12278 | 14 |
| 342 | 12296 | 12360 | 65 |
| 343 | 12362 | 12381 | 20 |
| 344 | 12384 | 12399 | 16 |
| 345 | 12400 | 12475 | 76 |
| 346 | 12487 | 12502 | 16 |
| 347 | 12504 | 12531 | 28 |
| 348 | 12533 | 12562 | 30 |
| 349 | 12564 | 12602 | 39 |
| 350 | 12627 | 12646 | 20 |
| 351 | 12655 | 12679 | 25 |
| 352 | 12681 | 12698 | 18 |
| 353 | 12700 | 12812 | 113 |
| 354 | 12828 | 12876 | 49 |
| 355 | 12877 | 12913 | 37 |
| 356 | 12932 | 12945 | 14 |
| 357 | 12936 | 12967 | 32 |
| 358 | 12988 | 13002 | 15 |
| 359 | 12996 | 13009 | 14 |
| 360 | 13018 | 13035 | 18 |
| 361 | 13031 | 13049 | 19 |
| 362 | 13056 | 13093 | 38 |
| 363 | 13096 | 13126 | 31 |
| 364 | 13128 | 13142 | 15 |
| 365 | 13144 | 13193 | 50 |
| 366 | 13201 | 13221 | 21 |
| 367 | 13223 | 13280 | 58 |
| 368 | 13282 | 13298 | 17 |
| 369 | 13300 | 13315 | 16 |
| 370 | 13307 | 13320 | 14 |
| 371 | 13315 | 13331 | 17 |
| 372 | 13351 | 13411 | 61 |
| 373 | 13422 | 13437 | 16 |
| 374 | 13439 | 13456 | 18 |
| 375 | 13461 | 13483 | 23 |
| 376 | 13485 | 13541 | 57 |
| 377 | 13543 | 13560 | 18 |
| 378 | 13574 | 13606 | 33 |
| 379 | 13618 | 13646 | 29 |
| 380 | 13778 | 13801 | 24 |
| 381 | 13994 | 14009 | 16 |
| 382 | 14508 | 14521 | 14 |
| 383 | 15049 | 15067 | 19 |
| 384 | 15069 | 15090 | 22 |
| 385 | 15102 | 15139 | 38 |
| 386 | 15142 | 15180 | 39 |
| 387 | 15182 | 15205 | 24 |
| 388 | 15238 | 15252 | 15 |
| 389 | 15254 | 15277 | 24 |
| 390 | 15292 | 15320 | 29 |
| 391 | 15322 | 15348 | 27 |
| 392 | 15343 | 15358 | 16 |
| 393 | 15362 | 15387 | 26 |
| 394 | 15399 | 15414 | 16 |
| 395 | 15416 | 15445 | 30 |
| 396 | 15459 | 15528 | 70 |
| 397 | 15537 | 15592 | 56 |
| 398 | 15610 | 15638 | 29 |
| 399 | 15640 | 15653 | 14 |
| 400 | 15655 | 15717 | 63 |
| 401 | 15719 | 15738 | 20 |
| 402 | 15757 | 15778 | 22 |
| 403 | 15783 | 15801 | 19 |
| 404 | 15818 | 15838 | 21 |
| 405 | 15835 | 15849 | 15 |
| 406 | 15840 | 15857 | 18 |
| 407 | 15856 | 15898 | 43 |
| 408 | 15900 | 15916 | 17 |
| 409 | 15931 | 15972 | 42 |
| 410 | 15988 | 16028 | 41 |
| 411 | 16030 | 16075 | 46 |
| 412 | 16103 | 16164 | 62 |
| 413 | 16207 | 16243 | 37 |
| 414 | 16233 | 16246 | 14 |
| 415 | 16255 | 16329 | 75 |
| 416 | 16349 | 16376 | 28 |
| 417 | 16378 | 16404 | 27 |
| 418 | 16399 | 16419 | 21 |
| 419 | 16421 | 16461 | 41 |
| 420 | 16463 | 16479 | 17 |
| 421 | 16481 | 16503 | 23 |
| 422 | 16506 | 16579 | 74 |
| 423 | 16582 | 16620 | 39 |
| 424 | 16622 | 16698 | 77 |
| 425 | 16700 | 16716 | 17 |
| 426 | 16723 | 16771 | 49 |
| 427 | 16786 | 16816 | 31 |
| 428 | 16835 | 16864 | 30 |
| 429 | 16865 | 16878 | 14 |
| 430 | 16872 | 16888 | 17 |
| 431 | 16890 | 16906 | 17 |
| 432 | 16904 | 16938 | 35 |
| 433 | 16965 | 17052 | 88 |
| 434 | 17054 | 17069 | 16 |
| 435 | 17071 | 17085 | 15 |
| 436 | 17083 | 17098 | 16 |
| 437 | 17088 | 17111 | 24 |
| 438 | 17124 | 17138 | 15 |
| 439 | 17140 | 17159 | 20 |
| 440 | 17181 | 17202 | 22 |
| 441 | 17202 | 17218 | 17 |
| 442 | 17229 | 17248 | 20 |
| 443 | 17250 | 17268 | 19 |
| 444 | 17332 | 17349 | 18 |
| 445 | 17363 | 17387 | 25 |
| 446 | 17389 | 17429 | 41 |
| 447 | 17450 | 17464 | 15 |
| 448 | 17482 | 17497 | 16 |
| 449 | 18104 | 18117 | 14 |
| 450 | 18418 | 18431 | 14 |
| 451 | 18613 | 18626 | 14 |
| 452 | 18620 | 18634 | 15 |
| 453 | 18707 | 18721 | 15 |
| 454 | 18841 | 18855 | 15 |
| 455 | 18875 | 18889 | 15 |
| 456 | 19282 | 19295 | 14 |
| 457 | 19310 | 19323 | 14 |
| 458 | 19454 | 19467 | 14 |
| 459 | 19774 | 19792 | 19 |
| 460 | 19794 | 19864 | 71 |
| 461 | 19862 | 19890 | 29 |
| 462 | 19892 | 19918 | 27 |
| 463 | 19907 | 19931 | 25 |
| 464 | 19927 | 19942 | 16 |
| 465 | 19932 | 19971 | 40 |
| 466 | 19973 | 20011 | 39 |

TABLE 1-continued

Regions of SEQ ID NO 1 which may be targeted using oligonucleotide of the invention

| Reg. A | Position in SEQ ID NO 1 from | to | Length |
|---|---|---|---|
| 467 | 20022 | 20063 | 42 |
| 468 | 20080 | 20093 | 14 |
| 469 | 20131 | 20144 | 14 |
| 470 | 20240 | 20253 | 14 |
| 471 | 20448 | 20463 | 16 |
| 472 | 20495 | 20508 | 14 |
| 473 | 20532 | 20545 | 14 |
| 474 | 20600 | 20613 | 14 |
| 475 | 20617 | 20630 | 14 |
| 476 | 20960 | 20977 | 18 |
| 477 | 21412 | 21428 | 17 |
| 478 | 21465 | 21479 | 15 |
| 479 | 21489 | 21508 | 20 |
| 480 | 21797 | 21812 | 16 |
| 481 | 22015 | 22030 | 16 |
| 482 | 22144 | 22157 | 14 |
| 483 | 22153 | 22167 | 15 |
| 484 | 22265 | 22278 | 14 |
| 485 | 23110 | 23123 | 14 |
| 486 | 23114 | 23133 | 20 |
| 487 | 23286 | 23303 | 18 |
| 488 | 23364 | 23379 | 16 |
| 489 | 23478 | 23498 | 21 |
| 490 | 23544 | 23587 | 44 |
| 491 | 23589 | 23630 | 42 |
| 492 | 23658 | 23676 | 19 |
| 493 | 23678 | 23702 | 25 |
| 494 | 23704 | 23729 | 26 |
| 495 | 23731 | 23748 | 18 |
| 496 | 23740 | 23755 | 16 |
| 497 | 23744 | 23757 | 14 |
| 498 | 23750 | 23764 | 15 |
| 499 | 23767 | 23795 | 29 |
| 500 | 23802 | 23816 | 15 |
| 501 | 23818 | 23831 | 14 |
| 502 | 23855 | 23869 | 15 |
| 503 | 23906 | 23926 | 21 |
| 504 | 23928 | 23942 | 15 |
| 505 | 23994 | 24007 | 14 |
| 506 | 24005 | 24018 | 14 |
| 507 | 24023 | 24056 | 34 |
| 508 | 24074 | 24088 | 15 |
| 509 | 24088 | 24104 | 17 |
| 510 | 24112 | 24163 | 52 |
| 511 | 24199 | 24212 | 14 |
| 512 | 24231 | 24244 | 14 |
| 513 | 24237 | 24252 | 16 |
| 514 | 24254 | 24267 | 14 |
| 515 | 24281 | 24325 | 45 |
| 516 | 24327 | 24353 | 27 |
| 517 | 24355 | 24374 | 20 |
| 518 | 24376 | 24399 | 24 |
| 519 | 24401 | 24416 | 16 |
| 520 | 24442 | 24489 | 48 |
| 521 | 24492 | 24506 | 15 |
| 522 | 24498 | 24511 | 14 |
| 523 | 24538 | 24556 | 19 |
| 524 | 24546 | 24562 | 17 |
| 525 | 24591 | 24618 | 28 |
| 526 | 24620 | 24633 | 14 |
| 527 | 24635 | 24650 | 16 |
| 528 | 24665 | 24681 | 17 |
| 529 | 24687 | 24706 | 20 |
| 530 | 24709 | 24729 | 21 |
| 531 | 24731 | 24752 | 22 |
| 532 | 24756 | 24771 | 16 |
| 533 | 24773 | 24788 | 16 |
| 534 | 24793 | 24821 | 29 |
| 535 | 24823 | 24854 | 32 |
| 536 | 24856 | 24870 | 15 |
| 537 | 24873 | 24922 | 50 |
| 538 | 24933 | 24954 | 22 |
| 539 | 24965 | 24984 | 20 |
| 540 | 25019 | 25052 | 34 |
| 541 | 25054 | 25099 | 46 |
| 542 | 25112 | 25125 | 14 |
| 543 | 25133 | 25169 | 37 |
| 544 | 25171 | 25184 | 14 |
| 545 | 25186 | 25221 | 36 |
| 546 | 25236 | 25253 | 18 |
| 547 | 25246 | 25296 | 51 |
| 548 | 25298 | 25336 | 39 |
| 549 | 25332 | 25348 | 17 |
| 550 | 25349 | 25363 | 15 |
| 551 | 25388 | 25432 | 45 |
| 552 | 25439 | 25462 | 24 |
| 553 | 25509 | 25523 | 15 |
| 554 | 25525 | 25547 | 23 |
| 555 | 25578 | 25593 | 16 |
| 556 | 25587 | 25601 | 15 |
| 557 | 25604 | 25617 | 14 |
| 558 | 25633 | 25655 | 23 |
| 559 | 25672 | 25716 | 45 |
| 560 | 25725 | 25738 | 14 |
| 561 | 25764 | 25800 | 37 |
| 562 | 25802 | 25828 | 27 |
| 563 | 25831 | 25846 | 16 |
| 564 | 25851 | 25872 | 22 |
| 565 | 25877 | 25904 | 28 |
| 566 | 25921 | 25946 | 26 |
| 567 | 25943 | 25970 | 28 |
| 568 | 25972 | 25986 | 15 |
| 569 | 26051 | 26064 | 14 |
| 570 | 26068 | 26086 | 19 |
| 571 | 26113 | 26137 | 25 |
| 572 | 26139 | 26159 | 21 |
| 573 | 26182 | 26197 | 16 |
| 574 | 26243 | 26296 | 54 |
| 575 | 26298 | 26313 | 16 |
| 576 | 26327 | 26350 | 24 |
| 577 | 26366 | 26385 | 20 |
| 578 | 26387 | 26404 | 18 |
| 579 | 26397 | 26415 | 19 |
| 580 | 26416 | 26453 | 38 |
| 581 | 26447 | 26461 | 15 |
| 582 | 26457 | 26471 | 15 |
| 583 | 26481 | 26498 | 18 |
| 584 | 26502 | 26525 | 24 |
| 585 | 26528 | 26562 | 35 |
| 586 | 26564 | 26590 | 27 |
| 587 | 26590 | 26622 | 33 |
| 588 | 26624 | 26638 | 15 |
| 589 | 26687 | 26702 | 16 |
| 590 | 26706 | 26719 | 14 |
| 591 | 26717 | 26730 | 14 |
| 592 | 26729 | 26743 | 15 |
| 593 | 26767 | 26797 | 31 |
| 594 | 26796 | 26816 | 21 |
| 595 | 26831 | 26847 | 17 |
| 596 | 26837 | 26850 | 14 |
| 597 | 26877 | 26890 | 14 |
| 598 | 26900 | 26922 | 23 |
| 599 | 26911 | 26933 | 23 |
| 600 | 26933 | 26946 | 14 |
| 601 | 26938 | 26977 | 40 |
| 602 | 26979 | 26992 | 14 |
| 603 | 26981 | 27017 | 37 |
| 604 | 27023 | 27041 | 19 |
| 605 | 27039 | 27055 | 17 |
| 606 | 27075 | 27121 | 47 |
| 607 | 27138 | 27153 | 16 |
| 608 | 27163 | 27266 | 104 |
| 609 | 27270 | 27293 | 24 |
| 610 | 27325 | 27358 | 34 |

TABLE 1-continued

Regions of SEQ ID NO 1 which may be targeted using oligonucleotide of the invention

| Reg. A | Position in SEQ ID NO 1 from | to | Length |
|---|---|---|---|
| 611 | 27363 | 27408 | 46 |
| 612 | 27419 | 27448 | 30 |
| 613 | 27450 | 27469 | 20 |
| 614 | 27471 | 27498 | 28 |
| 615 | 27510 | 27523 | 14 |
| 616 | 27535 | 27562 | 28 |
| 617 | 28098 | 28119 | 22 |
| 618 | 28136 | 28155 | 20 |
| 619 | 28169 | 28197 | 29 |
| 620 | 28199 | 28212 | 14 |
| 621 | 28221 | 28244 | 24 |
| 622 | 28271 | 28285 | 15 |
| 623 | 28400 | 28414 | 15 |
| 624 | 28441 | 28476 | 36 |
| 625 | 28490 | 28533 | 44 |
| 626 | 28535 | 28562 | 28 |
| 627 | 28575 | 28600 | 26 |
| 628 | 28621 | 28634 | 14 |
| 629 | 28650 | 28663 | 14 |
| 630 | 28674 | 28687 | 14 |
| 631 | 28681 | 28699 | 19 |
| 632 | 28713 | 28730 | 18 |
| 633 | 28736 | 28761 | 26 |
| 634 | 28763 | 28811 | 49 |
| 635 | 28821 | 28854 | 34 |
| 636 | 28856 | 28881 | 26 |
| 637 | 28883 | 28920 | 38 |
| 638 | 28922 | 28947 | 26 |
| 639 | 28979 | 29006 | 28 |
| 640 | 29008 | 29056 | 49 |
| 641 | 29078 | 29095 | 18 |
| 642 | 29098 | 29129 | 32 |
| 643 | 29122 | 29135 | 14 |
| 644 | 29131 | 29144 | 14 |
| 645 | 29144 | 29158 | 15 |
| 646 | 29160 | 29207 | 48 |
| 647 | 29209 | 29230 | 22 |
| 648 | 29234 | 29266 | 33 |
| 649 | 29268 | 29286 | 19 |
| 650 | 29301 | 29315 | 15 |
| 651 | 29304 | 29323 | 20 |
| 652 | 29330 | 29352 | 23 |
| 653 | 29344 | 29358 | 15 |
| 654 | 29347 | 29365 | 19 |
| 655 | 29377 | 29402 | 26 |
| 656 | 29402 | 29422 | 21 |
| 657 | 29424 | 29445 | 22 |
| 658 | 29443 | 29457 | 15 |
| 659 | 29447 | 29460 | 14 |
| 660 | 29462 | 29475 | 14 |
| 661 | 29491 | 29512 | 22 |
| 662 | 29514 | 29551 | 38 |
| 663 | 29547 | 29560 | 14 |
| 664 | 29553 | 29620 | 68 |
| 665 | 29625 | 29700 | 76 |
| 666 | 29714 | 29745 | 32 |
| 667 | 29774 | 29805 | 32 |
| 668 | 29816 | 29847 | 32 |
| 669 | 29875 | 29892 | 18 |
| 670 | 29894 | 29908 | 15 |
| 671 | 29897 | 29910 | 14 |
| 672 | 29917 | 29938 | 22 |
| 673 | 29939 | 29952 | 14 |
| 674 | 29961 | 29976 | 16 |
| 675 | 29974 | 29987 | 14 |
| 676 | 29978 | 30001 | 24 |
| 677 | 30006 | 30023 | 18 |
| 678 | 30025 | 30039 | 15 |
| 679 | 30043 | 30107 | 65 |
| 680 | 30145 | 30158 | 14 |
| 681 | 30149 | 30166 | 18 |
| 682 | 30173 | 30228 | 56 |
| 683 | 30230 | 30250 | 21 |
| 684 | 30251 | 30309 | 59 |
| 685 | 30321 | 30358 | 38 |
| 686 | 30359 | 30380 | 22 |
| 687 | 30382 | 30422 | 41 |
| 688 | 30428 | 30442 | 15 |
| 689 | 30455 | 30482 | 28 |
| 690 | 30484 | 30498 | 15 |
| 691 | 30516 | 30531 | 16 |
| 692 | 30533 | 30646 | 114 |
| 693 | 30654 | 30745 | 92 |
| 694 | 30745 | 30760 | 16 |
| 695 | 30752 | 30766 | 15 |
| 696 | 30788 | 30843 | 56 |
| 697 | 30845 | 30867 | 23 |
| 698 | 30869 | 30912 | 44 |
| 699 | 30906 | 30920 | 15 |
| 700 | 30934 | 30951 | 18 |
| 701 | 30962 | 30984 | 23 |
| 702 | 30989 | 31002 | 14 |
| 703 | 31010 | 31033 | 24 |
| 704 | 31036 | 31062 | 27 |
| 705 | 31092 | 31106 | 15 |
| 706 | 31128 | 31166 | 39 |
| 707 | 31168 | 31182 | 15 |
| 708 | 31189 | 31203 | 15 |
| 709 | 31205 | 31218 | 14 |
| 710 | 31224 | 31253 | 30 |
| 711 | 31256 | 31272 | 17 |
| 712 | 31274 | 31292 | 19 |
| 713 | 31294 | 31322 | 29 |
| 714 | 31324 | 31353 | 30 |
| 715 | 31357 | 31370 | 14 |
| 716 | 31373 | 31399 | 27 |
| 717 | 31403 | 31426 | 24 |
| 718 | 31445 | 31460 | 16 |
| 719 | 31463 | 31483 | 21 |
| 720 | 31485 | 31501 | 17 |
| 721 | 31494 | 31508 | 15 |
| 722 | 31507 | 31529 | 23 |
| 723 | 31531 | 31565 | 35 |
| 724 | 31567 | 31615 | 49 |
| 725 | 31630 | 31665 | 36 |
| 726 | 31675 | 31691 | 17 |
| 727 | 31703 | 31721 | 19 |
| 728 | 31729 | 31769 | 41 |
| 729 | 31770 | 31790 | 21 |
| 730 | 31795 | 31813 | 19 |
| 731 | 31815 | 31835 | 21 |
| 732 | 31837 | 31865 | 29 |
| 733 | 31876 | 31889 | 14 |
| 734 | 31920 | 31945 | 26 |
| 735 | 31962 | 31978 | 17 |
| 736 | 31983 | 32014 | 32 |
| 737 | 32029 | 32050 | 22 |
| 738 | 32058 | 32110 | 53 |
| 739 | 32129 | 32147 | 19 |
| 740 | 32166 | 32242 | 77 |
| 741 | 32244 | 32279 | 36 |
| 742 | 32296 | 32315 | 20 |
| 743 | 32334 | 32396 | 63 |
| 744 | 32398 | 32425 | 28 |
| 745 | 32427 | 32453 | 27 |
| 746 | 32459 | 32481 | 23 |
| 747 | 32475 | 32498 | 24 |
| 748 | 32490 | 32523 | 34 |
| 749 | 32519 | 32534 | 16 |
| 750 | 32525 | 32547 | 23 |
| 751 | 32542 | 32555 | 14 |
| 752 | 32559 | 32572 | 14 |
| 753 | 32574 | 32587 | 14 |
| 754 | 32595 | 32618 | 24 |

TABLE 1-continued

Regions of SEQ ID NO 1 which may be targeted using oligonucleotide of the invention

| Reg. A | Position in SEQ ID NO 1 from | to | Length |
|---|---|---|---|
| 755 | 32613 | 32626 | 14 |
| 756 | 32627 | 32649 | 23 |
| 757 | 32651 | 32664 | 14 |
| 758 | 32655 | 32689 | 35 |
| 759 | 32693 | 32719 | 27 |
| 760 | 32721 | 32750 | 30 |
| 761 | 32752 | 32778 | 27 |
| 762 | 32780 | 32795 | 16 |
| 763 | 32797 | 32847 | 51 |
| 764 | 32881 | 32894 | 14 |
| 765 | 32891 | 32904 | 14 |
| 766 | 32896 | 32911 | 16 |
| 767 | 32927 | 32972 | 46 |
| 768 | 32986 | 33017 | 32 |
| 769 | 33019 | 33036 | 18 |
| 770 | 33038 | 33096 | 59 |
| 771 | 33102 | 33123 | 22 |
| 772 | 33132 | 33145 | 14 |
| 773 | 33150 | 33163 | 14 |
| 774 | 33166 | 33199 | 34 |
| 775 | 33214 | 33260 | 47 |
| 776 | 33262 | 33292 | 31 |
| 777 | 33294 | 33307 | 14 |
| 778 | 33316 | 33351 | 36 |
| 779 | 33360 | 33402 | 43 |
| 780 | 33412 | 33425 | 14 |
| 781 | 33427 | 33442 | 16 |
| 782 | 33439 | 33452 | 14 |
| 783 | 33443 | 33456 | 14 |
| 784 | 33460 | 33501 | 42 |
| 785 | 33503 | 33535 | 33 |
| 786 | 33542 | 33557 | 16 |
| 787 | 34168 | 34181 | 14 |
| 788 | 34370 | 34385 | 16 |
| 789 | 35422 | 35435 | 14 |
| 790 | 35627 | 35641 | 15 |
| 791 | 35685 | 35700 | 16 |
| 792 | 35837 | 35851 | 15 |
| 793 | 35849 | 35864 | 16 |
| 794 | 35866 | 35879 | 14 |
| 795 | 35974 | 35987 | 14 |
| 796 | 36009 | 36042 | 34 |
| 797 | 36044 | 36079 | 36 |
| 798 | 36081 | 36097 | 17 |
| 799 | 36099 | 36120 | 22 |
| 800 | 36119 | 36133 | 15 |
| 801 | 36147 | 36163 | 17 |
| 802 | 36171 | 36200 | 30 |
| 803 | 36216 | 36241 | 26 |
| 804 | 36245 | 36274 | 30 |
| 805 | 36265 | 36283 | 19 |
| 806 | 36295 | 36348 | 54 |
| 807 | 36352 | 36389 | 38 |
| 808 | 36383 | 36400 | 18 |
| 809 | 36402 | 36419 | 18 |
| 810 | 36475 | 36520 | 46 |
| 811 | 36522 | 36539 | 18 |
| 812 | 36541 | 36626 | 86 |
| 813 | 36652 | 36672 | 21 |
| 814 | 36675 | 36705 | 31 |
| 815 | 36707 | 36746 | 40 |
| 816 | 36780 | 36808 | 29 |
| 817 | 36810 | 36823 | 14 |
| 818 | 36825 | 36901 | 77 |
| 819 | 36903 | 36922 | 20 |
| 820 | 36924 | 36982 | 59 |
| 821 | 36999 | 37030 | 32 |
| 822 | 37056 | 37083 | 28 |
| 823 | 37091 | 37135 | 45 |
| 824 | 37194 | 37221 | 28 |
| 825 | 37238 | 37277 | 40 |
| 826 | 37280 | 37294 | 15 |
| 827 | 37298 | 37315 | 18 |
| 828 | 37325 | 37350 | 26 |
| 829 | 37363 | 37383 | 21 |
| 830 | 37377 | 37394 | 18 |
| 831 | 37384 | 37397 | 14 |
| 832 | 37390 | 37438 | 49 |
| 833 | 37456 | 37481 | 26 |
| 834 | 37478 | 37491 | 14 |
| 835 | 37481 | 37503 | 23 |
| 836 | 37506 | 37524 | 19 |
| 837 | 37526 | 37545 | 20 |
| 838 | 37540 | 37572 | 33 |
| 839 | 37574 | 37590 | 17 |
| 840 | 37601 | 37616 | 16 |
| 841 | 37621 | 37658 | 38 |
| 842 | 37673 | 37690 | 18 |
| 843 | 37703 | 37738 | 36 |
| 844 | 37740 | 37753 | 14 |
| 845 | 37764 | 37790 | 27 |
| 846 | 37800 | 37818 | 19 |
| 847 | 37820 | 37850 | 31 |
| 848 | 37888 | 37909 | 22 |
| 849 | 37911 | 37972 | 62 |
| 850 | 37986 | 38014 | 29 |
| 851 | 38016 | 38032 | 17 |
| 852 | 38034 | 38053 | 20 |
| 853 | 38055 | 38073 | 19 |
| 854 | 38075 | 38090 | 16 |
| 855 | 38092 | 38128 | 37 |
| 856 | 38141 | 38167 | 27 |
| 857 | 38171 | 38194 | 24 |
| 858 | 38213 | 38240 | 28 |
| 859 | 38264 | 38286 | 23 |
| 860 | 38288 | 38370 | 83 |
| 861 | 38394 | 38420 | 27 |
| 862 | 38452 | 38467 | 16 |
| 863 | 38471 | 38487 | 17 |
| 864 | 38477 | 38490 | 14 |
| 865 | 38494 | 38507 | 14 |
| 866 | 38536 | 38556 | 21 |
| 867 | 38580 | 38593 | 14 |
| 868 | 38602 | 38618 | 17 |
| 869 | 38628 | 38654 | 27 |
| 870 | 38693 | 38709 | 17 |
| 871 | 38709 | 38722 | 14 |
| 872 | 38711 | 38725 | 15 |
| 873 | 38740 | 38756 | 17 |
| 874 | 38749 | 38769 | 21 |
| 875 | 38772 | 38797 | 26 |
| 876 | 38827 | 38846 | 20 |
| 877 | 38860 | 38883 | 24 |
| 878 | 38885 | 38905 | 21 |
| 879 | 38911 | 38931 | 21 |
| 880 | 38933 | 38949 | 17 |
| 881 | 38962 | 39032 | 71 |
| 882 | 39034 | 39047 | 14 |
| 883 | 39049 | 39070 | 22 |
| 884 | 39075 | 39115 | 41 |
| 885 | 39127 | 39143 | 17 |
| 886 | 39148 | 39162 | 15 |
| 887 | 39164 | 39222 | 59 |
| 888 | 39218 | 39231 | 14 |
| 889 | 39224 | 39256 | 33 |
| 890 | 39265 | 39306 | 42 |
| 891 | 39297 | 39311 | 15 |
| 892 | 39308 | 39343 | 36 |
| 893 | 39345 | 39359 | 15 |
| 894 | 39361 | 39381 | 21 |
| 895 | 39370 | 39383 | 14 |
| 896 | 39383 | 39399 | 17 |
| 897 | 39417 | 39469 | 53 |
| 898 | 39490 | 39503 | 14 |

TABLE 1-continued

Regions of SEQ ID NO 1 which may be targeted using oligonucleotide of the invention

| Reg. A | Position in SEQ ID NO 1 from | to | Length |
|---|---|---|---|
| 899 | 39500 | 39522 | 23 |
| 900 | 39535 | 39549 | 15 |
| 901 | 39551 | 39611 | 61 |
| 902 | 39628 | 39647 | 20 |
| 903 | 39649 | 39690 | 42 |
| 904 | 39707 | 39759 | 53 |
| 905 | 39773 | 39797 | 25 |
| 906 | 39799 | 39858 | 60 |
| 907 | 39872 | 39928 | 57 |
| 908 | 39930 | 39969 | 40 |
| 909 | 39973 | 39997 | 25 |
| 910 | 39998 | 40013 | 16 |
| 911 | 40015 | 40064 | 50 |
| 912 | 40067 | 40108 | 42 |
| 913 | 40110 | 40140 | 31 |
| 914 | 40147 | 40163 | 17 |
| 915 | 40154 | 40179 | 26 |
| 916 | 40181 | 40196 | 16 |
| 917 | 40232 | 40282 | 51 |
| 918 | 40284 | 40307 | 24 |
| 919 | 40309 | 40368 | 60 |
| 920 | 40381 | 40399 | 19 |
| 921 | 40431 | 40471 | 41 |
| 922 | 40479 | 40493 | 15 |
| 923 | 40484 | 40522 | 39 |
| 924 | 40524 | 40544 | 21 |
| 925 | 40547 | 40561 | 15 |
| 926 | 40577 | 40594 | 18 |
| 927 | 40586 | 40599 | 14 |
| 928 | 40616 | 40631 | 16 |
| 929 | 40634 | 40647 | 14 |
| 930 | 40674 | 40727 | 54 |
| 931 | 40738 | 40755 | 18 |
| 932 | 40749 | 40771 | 23 |
| 933 | 40780 | 40802 | 23 |
| 934 | 40811 | 40834 | 24 |
| 935 | 40847 | 40865 | 19 |
| 936 | 40861 | 40875 | 15 |
| 937 | 40869 | 40897 | 29 |
| 938 | 40899 | 40919 | 21 |
| 939 | 40921 | 40939 | 19 |
| 940 | 40942 | 40962 | 21 |
| 941 | 40967 | 40980 | 14 |
| 942 | 41008 | 41097 | 90 |
| 943 | 41099 | 41131 | 33 |
| 944 | 41133 | 41200 | 68 |
| 945 | 41202 | 41223 | 22 |
| 946 | 41225 | 41242 | 18 |
| 947 | 41266 | 41279 | 14 |
| 948 | 41275 | 41298 | 24 |
| 949 | 41300 | 41321 | 22 |
| 950 | 41325 | 41360 | 36 |
| 951 | 41367 | 41388 | 22 |
| 952 | 41403 | 41421 | 19 |
| 953 | 41439 | 41462 | 24 |
| 954 | 41481 | 41496 | 16 |
| 955 | 41508 | 41523 | 16 |
| 956 | 41531 | 41550 | 20 |
| 957 | 41552 | 41590 | 39 |
| 958 | 41590 | 41603 | 14 |
| 959 | 41612 | 41662 | 51 |
| 960 | 41664 | 41688 | 25 |
| 961 | 41685 | 41698 | 14 |
| 962 | 41691 | 41716 | 26 |
| 963 | 41718 | 41764 | 47 |
| 964 | 41761 | 41776 | 16 |
| 965 | 41778 | 41809 | 32 |
| 966 | 41798 | 41811 | 14 |
| 967 | 41838 | 41866 | 29 |
| 968 | 41872 | 41893 | 22 |
| 969 | 41885 | 41898 | 14 |
| 970 | 41912 | 41925 | 14 |
| 971 | 41914 | 41930 | 17 |
| 972 | 41923 | 41942 | 20 |
| 973 | 41933 | 41956 | 24 |
| 974 | 41962 | 41978 | 17 |
| 975 | 41997 | 42012 | 16 |
| 976 | 42026 | 42042 | 17 |
| 977 | 42035 | 42048 | 14 |
| 978 | 42037 | 42050 | 14 |
| 979 | 42048 | 42064 | 17 |
| 980 | 42056 | 42079 | 24 |
| 981 | 42081 | 42095 | 15 |
| 982 | 42096 | 42139 | 44 |
| 983 | 42141 | 42187 | 47 |
| 984 | 42190 | 42226 | 37 |
| 985 | 42232 | 42253 | 22 |
| 986 | 42255 | 42305 | 51 |
| 987 | 42307 | 42320 | 14 |
| 988 | 42347 | 42375 | 29 |
| 989 | 42389 | 42425 | 37 |
| 990 | 42427 | 42442 | 16 |
| 991 | 42452 | 42474 | 23 |
| 992 | 42482 | 42496 | 15 |
| 993 | 42495 | 42509 | 15 |
| 994 | 42536 | 42550 | 15 |
| 995 | 42566 | 42580 | 15 |
| 996 | 42590 | 42612 | 23 |
| 997 | 42646 | 42678 | 33 |
| 998 | 42683 | 42723 | 41 |
| 999 | 42735 | 42750 | 16 |
| 1000 | 42752 | 42817 | 66 |
| 1001 | 42843 | 42873 | 31 |
| 1002 | 42890 | 42939 | 50 |
| 1003 | 42938 | 42989 | 52 |
| 1004 | 42991 | 43005 | 15 |
| 1005 | 43007 | 43020 | 14 |
| 1006 | 43036 | 43055 | 20 |
| 1007 | 43057 | 43102 | 46 |
| 1008 | 43113 | 43145 | 33 |
| 1009 | 43147 | 43180 | 34 |
| 1010 | 43204 | 43221 | 18 |
| 1011 | 43221 | 43265 | 45 |
| 1012 | 43267 | 43296 | 30 |
| 1013 | 43311 | 43334 | 24 |
| 1014 | 43336 | 43361 | 26 |
| 1015 | 43371 | 43395 | 25 |
| 1016 | 43399 | 43423 | 25 |
| 1017 | 43425 | 43453 | 29 |
| 1018 | 43452 | 43468 | 17 |
| 1019 | 43470 | 43488 | 19 |
| 1020 | 43495 | 43522 | 28 |
| 1021 | 43525 | 43559 | 35 |
| 1022 | 43561 | 43584 | 24 |
| 1023 | 43590 | 43611 | 22 |
| 1024 | 43618 | 43650 | 33 |
| 1025 | 43670 | 43685 | 16 |
| 1026 | 43722 | 43774 | 53 |
| 1027 | 43776 | 43791 | 16 |
| 1028 | 43808 | 43835 | 28 |
| 1029 | 43835 | 43851 | 17 |
| 1030 | 43853 | 43868 | 16 |
| 1031 | 43923 | 43937 | 15 |
| 1032 | 43952 | 43987 | 36 |
| 1033 | 44011 | 44029 | 19 |
| 1034 | 44028 | 44070 | 43 |
| 1035 | 44072 | 44094 | 23 |
| 1036 | 44101 | 44130 | 30 |
| 1037 | 44137 | 44205 | 69 |
| 1038 | 44224 | 44244 | 21 |
| 1039 | 44246 | 44265 | 20 |
| 1040 | 44267 | 44318 | 52 |
| 1041 | 44316 | 44336 | 21 |
| 1042 | 44338 | 44359 | 22 |

TABLE 1-continued

Regions of SEQ ID NO 1 which may be targeted using oligonucleotide of the invention

| Reg. A | Position in SEQ ID NO 1 from | to | Length |
|---|---|---|---|
| 1043 | 44361 | 44424 | 64 |
| 1044 | 44439 | 44474 | 36 |
| 1045 | 44476 | 44500 | 25 |
| 1046 | 44502 | 44519 | 18 |
| 1047 | 44539 | 44553 | 15 |
| 1048 | 44563 | 44578 | 16 |
| 1049 | 44585 | 44599 | 15 |
| 1050 | 44601 | 44617 | 17 |
| 1051 | 44640 | 44701 | 62 |
| 1052 | 44704 | 44723 | 20 |
| 1053 | 44741 | 44763 | 23 |
| 1054 | 44766 | 44846 | 81 |
| 1055 | 44870 | 44889 | 20 |
| 1056 | 44887 | 44905 | 19 |
| 1057 | 44920 | 44947 | 28 |
| 1058 | 44949 | 44966 | 18 |
| 1059 | 44994 | 45022 | 29 |
| 1060 | 45042 | 45059 | 18 |
| 1061 | 45061 | 45087 | 27 |
| 1062 | 45116 | 45154 | 39 |
| 1063 | 45156 | 45182 | 27 |
| 1064 | 45183 | 45198 | 16 |
| 1065 | 45210 | 45243 | 34 |
| 1066 | 45245 | 45320 | 76 |
| 1067 | 45331 | 45367 | 37 |
| 1068 | 45380 | 45399 | 20 |
| 1069 | 45415 | 45428 | 14 |
| 1070 | 45421 | 45486 | 66 |
| 1071 | 45488 | 45545 | 58 |
| 1072 | 45556 | 45576 | 21 |
| 1073 | 45578 | 45597 | 20 |
| 1074 | 45603 | 45650 | 48 |
| 1075 | 45652 | 45665 | 14 |
| 1076 | 45675 | 45715 | 41 |
| 1077 | 45749 | 45763 | 15 |
| 1078 | 45804 | 45826 | 23 |
| 1079 | 45839 | 45861 | 23 |
| 1080 | 45878 | 45910 | 33 |
| 1081 | 45926 | 45954 | 29 |
| 1082 | 45956 | 45975 | 20 |
| 1083 | 45977 | 45997 | 21 |
| 1084 | 45999 | 46020 | 22 |
| 1085 | 46046 | 46063 | 18 |
| 1086 | 46065 | 46088 | 24 |
| 1087 | 46097 | 46118 | 22 |
| 1088 | 46120 | 46142 | 23 |
| 1089 | 46144 | 46160 | 17 |
| 1090 | 46162 | 46185 | 24 |
| 1091 | 46204 | 46280 | 77 |
| 1092 | 46302 | 46326 | 25 |
| 1093 | 46328 | 46355 | 28 |
| 1094 | 46358 | 46377 | 20 |
| 1095 | 46379 | 46436 | 58 |
| 1096 | 46457 | 46471 | 15 |
| 1097 | 46473 | 46492 | 20 |
| 1098 | 46501 | 46541 | 41 |
| 1099 | 46543 | 46572 | 30 |
| 1100 | 46584 | 46626 | 43 |
| 1101 | 46655 | 46683 | 29 |
| 1102 | 46685 | 46702 | 18 |
| 1103 | 46704 | 46722 | 19 |
| 1104 | 46724 | 46763 | 40 |
| 1105 | 46784 | 46800 | 17 |
| 1106 | 46802 | 46827 | 26 |
| 1107 | 46830 | 46867 | 38 |
| 1108 | 46869 | 46887 | 19 |
| 1109 | 46889 | 46920 | 32 |
| 1110 | 46922 | 46947 | 26 |
| 1111 | 46976 | 47009 | 34 |
| 1112 | 47011 | 47030 | 20 |
| 1113 | 47032 | 47064 | 33 |
| 1114 | 47066 | 47092 | 27 |
| 1115 | 47108 | 47130 | 23 |
| 1116 | 47132 | 47168 | 37 |
| 1117 | 47170 | 47199 | 30 |
| 1118 | 47201 | 47222 | 22 |
| 1119 | 47238 | 47277 | 40 |
| 1120 | 47296 | 47350 | 55 |
| 1121 | 47352 | 47391 | 40 |
| 1122 | 47416 | 47440 | 25 |
| 1123 | 47452 | 47466 | 15 |
| 1124 | 47468 | 47523 | 56 |
| 1125 | 47522 | 47546 | 25 |
| 1126 | 47548 | 47567 | 20 |
| 1127 | 47569 | 47595 | 27 |
| 1128 | 47597 | 47634 | 38 |
| 1129 | 47657 | 47693 | 37 |
| 1130 | 47712 | 47731 | 20 |
| 1131 | 47749 | 47762 | 14 |
| 1132 | 47771 | 47825 | 55 |
| 1133 | 47827 | 47846 | 20 |
| 1134 | 47848 | 47872 | 25 |
| 1135 | 47874 | 47888 | 15 |
| 1136 | 47890 | 47909 | 20 |
| 1137 | 47911 | 47925 | 15 |
| 1138 | 47927 | 47952 | 26 |
| 1139 | 47961 | 47993 | 33 |
| 1140 | 48001 | 48016 | 16 |
| 1141 | 48051 | 48083 | 33 |
| 1142 | 48096 | 48158 | 63 |
| 1143 | 48158 | 48176 | 19 |
| 1144 | 48186 | 48201 | 16 |
| 1145 | 48213 | 48239 | 27 |
| 1146 | 48241 | 48256 | 16 |
| 1147 | 48258 | 48278 | 21 |
| 1148 | 48280 | 48339 | 60 |
| 1149 | 48341 | 48357 | 17 |
| 1150 | 48359 | 48377 | 19 |
| 1151 | 48379 | 48393 | 15 |
| 1152 | 48395 | 48488 | 94 |
| 1153 | 48492 | 48510 | 19 |
| 1154 | 48528 | 48549 | 22 |
| 1155 | 48550 | 48589 | 40 |
| 1156 | 48636 | 48658 | 23 |
| 1157 | 48683 | 48697 | 15 |
| 1158 | 48699 | 48762 | 64 |
| 1159 | 48762 | 48775 | 14 |
| 1160 | 48773 | 48832 | 60 |
| 1161 | 48873 | 48886 | 14 |
| 1162 | 48888 | 48914 | 27 |
| 1163 | 48916 | 48944 | 29 |
| 1164 | 48969 | 49008 | 40 |
| 1165 | 49010 | 49024 | 15 |
| 1166 | 49051 | 49110 | 60 |
| 1167 | 49116 | 49150 | 35 |
| 1168 | 49151 | 49184 | 34 |
| 1169 | 49187 | 49200 | 14 |
| 1170 | 49213 | 49230 | 18 |
| 1171 | 49233 | 49247 | 15 |
| 1172 | 49267 | 49284 | 18 |
| 1173 | 49297 | 49310 | 14 |
| 1174 | 49317 | 49369 | 53 |
| 1175 | 49371 | 49435 | 65 |
| 1176 | 49444 | 49458 | 15 |
| 1177 | 49467 | 49500 | 34 |
| 1178 | 49510 | 49538 | 29 |
| 1179 | 49540 | 49559 | 20 |
| 1180 | 49561 | 49584 | 24 |
| 1181 | 49591 | 49626 | 36 |
| 1182 | 49628 | 49646 | 19 |
| 1183 | 49653 | 49737 | 85 |
| 1184 | 49787 | 49802 | 16 |
| 1185 | 49817 | 49835 | 19 |
| 1186 | 49841 | 49860 | 20 |

TABLE 1-continued

Regions of SEQ ID NO 1 which may be targeted using oligonucleotide of the invention

| Reg. A | Position in SEQ ID NO 1 from | to | Length |
|---|---|---|---|
| 1187 | 49862 | 49883 | 22 |
| 1188 | 49885 | 49905 | 21 |
| 1189 | 49921 | 49950 | 30 |
| 1190 | 49961 | 49979 | 19 |
| 1191 | 49995 | 50051 | 57 |
| 1192 | 50053 | 50071 | 19 |
| 1193 | 50073 | 50088 | 16 |
| 1194 | 50132 | 50158 | 27 |
| 1195 | 50167 | 50183 | 17 |
| 1196 | 50201 | 50226 | 26 |
| 1197 | 50226 | 50239 | 14 |
| 1198 | 50259 | 50313 | 55 |
| 1199 | 50323 | 50341 | 19 |
| 1200 | 50343 | 50396 | 54 |
| 1201 | 50390 | 50403 | 14 |
| 1202 | 50398 | 50448 | 51 |
| 1203 | 50451 | 50483 | 33 |
| 1204 | 50489 | 50507 | 19 |
| 1205 | 50526 | 50548 | 23 |
| 1206 | 50550 | 50569 | 20 |
| 1207 | 50575 | 50602 | 28 |
| 1208 | 50606 | 50621 | 16 |
| 1209 | 50617 | 50630 | 14 |
| 1210 | 50623 | 50641 | 19 |
| 1211 | 50634 | 50647 | 14 |
| 1212 | 50644 | 50663 | 20 |
| 1213 | 50665 | 50684 | 20 |
| 1214 | 50705 | 50730 | 26 |
| 1215 | 50732 | 50763 | 32 |
| 1216 | 50766 | 50799 | 34 |
| 1217 | 50797 | 50823 | 27 |
| 1218 | 50838 | 50864 | 27 |
| 1219 | 50870 | 50884 | 15 |
| 1220 | 50885 | 50911 | 27 |
| 1221 | 50924 | 50937 | 14 |
| 1222 | 50939 | 50974 | 36 |
| 1223 | 50980 | 51008 | 29 |
| 1224 | 51015 | 51030 | 16 |
| 1225 | 51034 | 51047 | 14 |
| 1226 | 51075 | 51089 | 15 |
| 1227 | 51109 | 51123 | 15 |
| 1228 | 51135 | 51172 | 38 |
| 1229 | 51189 | 51216 | 28 |
| 1230 | 51241 | 51260 | 20 |
| 1231 | 51273 | 51294 | 22 |
| 1232 | 51296 | 51312 | 17 |
| 1233 | 51337 | 51357 | 21 |
| 1234 | 51356 | 51381 | 26 |
| 1235 | 51393 | 51465 | 73 |
| 1236 | 51476 | 51494 | 19 |
| 1237 | 51496 | 51515 | 20 |
| 1238 | 51530 | 51544 | 15 |
| 1239 | 51546 | 51572 | 27 |
| 1240 | 51586 | 51600 | 15 |
| 1241 | 51602 | 51617 | 16 |
| 1242 | 51619 | 51677 | 59 |
| 1243 | 51679 | 51700 | 22 |
| 1244 | 51727 | 51741 | 15 |
| 1245 | 51743 | 51821 | 79 |
| 1246 | 51826 | 51859 | 34 |
| 1247 | 51884 | 51912 | 29 |
| 1248 | 51918 | 51936 | 19 |
| 1249 | 51947 | 51979 | 33 |
| 1250 | 52004 | 52017 | 14 |
| 1251 | 52023 | 52048 | 26 |
| 1252 | 52141 | 52167 | 27 |
| 1253 | 52169 | 52188 | 20 |
| 1254 | 52204 | 52225 | 22 |
| 1255 | 52246 | 52262 | 17 |
| 1256 | 52289 | 52306 | 18 |
| 1257 | 52321 | 52339 | 19 |
| 1258 | 52341 | 52360 | 20 |
| 1259 | 52360 | 52428 | 69 |
| 1260 | 52430 | 52504 | 75 |
| 1261 | 52506 | 52567 | 62 |
| 1262 | 52579 | 52594 | 16 |
| 1263 | 52591 | 52610 | 20 |
| 1264 | 52612 | 52642 | 31 |
| 1265 | 52644 | 52667 | 24 |
| 1266 | 52672 | 52686 | 15 |
| 1267 | 52688 | 52702 | 15 |
| 1268 | 52715 | 52753 | 39 |
| 1269 | 52770 | 52783 | 14 |
| 1270 | 52779 | 52792 | 14 |
| 1271 | 52814 | 52845 | 32 |
| 1272 | 52834 | 52857 | 24 |
| 1273 | 52858 | 52885 | 28 |
| 1274 | 52887 | 52943 | 57 |
| 1275 | 52945 | 52962 | 18 |
| 1276 | 52971 | 53019 | 49 |
| 1277 | 53011 | 53036 | 26 |
| 1278 | 53053 | 53066 | 14 |
| 1279 | 53092 | 53112 | 21 |
| 1280 | 53124 | 53151 | 28 |
| 1281 | 53161 | 53175 | 15 |
| 1282 | 53184 | 53220 | 37 |
| 1283 | 53222 | 53243 | 22 |
| 1284 | 53245 | 53260 | 16 |
| 1285 | 53278 | 53304 | 27 |
| 1286 | 53311 | 53346 | 36 |
| 1287 | 53364 | 53386 | 23 |
| 1288 | 53388 | 53404 | 17 |
| 1289 | 53417 | 53431 | 15 |
| 1290 | 53449 | 53463 | 15 |
| 1291 | 53465 | 53484 | 20 |
| 1292 | 53514 | 53527 | 14 |
| 1293 | 53552 | 53567 | 16 |
| 1294 | 53570 | 53591 | 22 |
| 1295 | 53618 | 53644 | 27 |
| 1296 | 53645 | 53667 | 23 |
| 1297 | 53669 | 53684 | 16 |
| 1298 | 53714 | 53742 | 29 |
| 1299 | 53744 | 53764 | 21 |
| 1300 | 53818 | 53843 | 26 |
| 1301 | 53845 | 53860 | 16 |
| 1302 | 53875 | 53889 | 15 |
| 1303 | 53961 | 53991 | 31 |
| 1304 | 53991 | 54013 | 23 |
| 1305 | 54015 | 54055 | 41 |
| 1306 | 54057 | 54081 | 25 |
| 1307 | 54114 | 54135 | 22 |
| 1308 | 54163 | 54178 | 16 |
| 1309 | 54180 | 54193 | 14 |
| 1310 | 54195 | 54254 | 60 |
| 1311 | 54261 | 54290 | 30 |
| 1312 | 54292 | 54307 | 16 |
| 1313 | 54309 | 54327 | 19 |
| 1314 | 54357 | 54372 | 16 |
| 1315 | 54404 | 54420 | 17 |
| 1316 | 54418 | 54439 | 22 |
| 1317 | 54441 | 54466 | 26 |
| 1318 | 54468 | 54512 | 45 |
| 1319 | 54519 | 54532 | 14 |
| 1320 | 54555 | 54572 | 18 |
| 1321 | 54588 | 54601 | 14 |
| 1322 | 54609 | 54633 | 25 |
| 1323 | 54644 | 54688 | 45 |
| 1324 | 54690 | 54721 | 32 |
| 1325 | 54723 | 54761 | 39 |
| 1326 | 54786 | 54802 | 17 |
| 1327 | 54819 | 54835 | 17 |
| 1328 | 54837 | 54912 | 76 |
| 1329 | 54924 | 54941 | 18 |
| 1330 | 54999 | 55017 | 19 |

TABLE 1-continued

Regions of SEQ ID NO 1 which may be targeted using oligonucleotide of the invention

| Reg. A | Position in SEQ ID NO 1 from | to | Length |
|---|---|---|---|
| 1331 | 55019 | 55035 | 17 |
| 1332 | 55060 | 55073 | 14 |
| 1333 | 55075 | 55100 | 26 |
| 1334 | 55129 | 55171 | 43 |
| 1335 | 55173 | 55188 | 16 |
| 1336 | 55190 | 55203 | 14 |
| 1337 | 55210 | 55230 | 21 |
| 1338 | 55233 | 55281 | 49 |
| 1339 | 55276 | 55289 | 14 |
| 1340 | 55283 | 55320 | 38 |
| 1341 | 55330 | 55379 | 50 |
| 1342 | 55381 | 55423 | 43 |
| 1343 | 55420 | 55441 | 22 |
| 1344 | 55486 | 55502 | 17 |
| 1345 | 55515 | 55533 | 19 |
| 1346 | 55535 | 55553 | 19 |
| 1347 | 55555 | 55569 | 15 |
| 1348 | 55569 | 55588 | 20 |
| 1349 | 55590 | 55611 | 22 |
| 1350 | 55615 | 55663 | 49 |
| 1351 | 55665 | 55678 | 14 |
| 1352 | 55696 | 55713 | 18 |
| 1353 | 55715 | 55738 | 24 |
| 1354 | 55744 | 55774 | 31 |
| 1355 | 55776 | 55794 | 19 |
| 1356 | 55801 | 55823 | 23 |
| 1357 | 55862 | 55906 | 45 |
| 1358 | 55920 | 55933 | 14 |
| 1359 | 55922 | 55947 | 26 |
| 1360 | 55974 | 55993 | 20 |
| 1361 | 55990 | 56031 | 42 |
| 1362 | 56045 | 56073 | 29 |
| 1363 | 56082 | 56114 | 33 |
| 1364 | 56117 | 56140 | 24 |
| 1365 | 56183 | 56214 | 32 |
| 1366 | 56218 | 56236 | 19 |
| 1367 | 56261 | 56282 | 22 |
| 1368 | 56311 | 56336 | 26 |
| 1369 | 56331 | 56345 | 15 |
| 1370 | 56338 | 56358 | 21 |
| 1371 | 56369 | 56390 | 22 |
| 1372 | 56391 | 56431 | 41 |
| 1373 | 56433 | 56451 | 19 |
| 1374 | 56453 | 56473 | 21 |
| 1375 | 56475 | 56498 | 24 |
| 1376 | 56500 | 56546 | 47 |
| 1377 | 56558 | 56581 | 24 |
| 1378 | 56584 | 56597 | 14 |
| 1379 | 56611 | 56647 | 37 |
| 1380 | 56643 | 56657 | 15 |
| 1381 | 56667 | 56691 | 25 |
| 1382 | 56732 | 56759 | 28 |
| 1383 | 56788 | 56805 | 18 |
| 1384 | 56821 | 56845 | 25 |
| 1385 | 56850 | 56882 | 33 |
| 1386 | 56885 | 56906 | 22 |
| 1387 | 56928 | 56942 | 15 |
| 1388 | 56944 | 56959 | 16 |
| 1389 | 56961 | 56975 | 15 |
| 1390 | 56984 | 57002 | 19 |
| 1391 | 57004 | 57041 | 38 |
| 1392 | 57057 | 57082 | 26 |
| 1393 | 57084 | 57122 | 39 |
| 1394 | 57162 | 57222 | 61 |
| 1395 | 57224 | 57246 | 23 |
| 1396 | 57259 | 57284 | 26 |
| 1397 | 57317 | 57332 | 16 |
| 1398 | 57346 | 57369 | 24 |
| 1399 | 57388 | 57423 | 36 |
| 1400 | 57425 | 57440 | 16 |
| 1401 | 57442 | 57455 | 14 |
| 1402 | 57475 | 57492 | 18 |
| 1403 | 57508 | 57522 | 15 |
| 1404 | 57522 | 57546 | 25 |
| 1405 | 57548 | 57576 | 29 |
| 1406 | 57593 | 57634 | 42 |
| 1407 | 57658 | 57675 | 18 |
| 1408 | 57687 | 57771 | 85 |
| 1409 | 57786 | 57803 | 18 |
| 1410 | 57801 | 57819 | 19 |
| 1411 | 57830 | 57858 | 29 |
| 1412 | 57889 | 57911 | 23 |
| 1413 | 57926 | 57945 | 20 |
| 1414 | 57947 | 57972 | 26 |
| 1415 | 58009 | 58028 | 20 |
| 1416 | 58030 | 58060 | 31 |
| 1417 | 58063 | 58091 | 29 |
| 1418 | 58124 | 58146 | 23 |
| 1419 | 58147 | 58162 | 16 |
| 1420 | 58163 | 58198 | 36 |
| 1421 | 58214 | 58292 | 79 |
| 1422 | 58292 | 58309 | 18 |
| 1423 | 58336 | 58429 | 94 |
| 1424 | 58436 | 58457 | 22 |
| 1425 | 58453 | 58501 | 49 |
| 1426 | 58525 | 58553 | 29 |
| 1427 | 58566 | 58579 | 14 |
| 1428 | 58571 | 58584 | 14 |
| 1429 | 58586 | 58601 | 16 |
| 1430 | 58604 | 58630 | 27 |
| 1431 | 58656 | 58682 | 27 |
| 1432 | 58696 | 58713 | 18 |
| 1433 | 58722 | 58744 | 23 |
| 1434 | 58757 | 58771 | 15 |
| 1435 | 58805 | 58979 | 175 |
| 1436 | 58987 | 59073 | 87 |
| 1437 | 59072 | 59123 | 52 |
| 1438 | 59124 | 59150 | 27 |
| 1439 | 59154 | 59234 | 81 |
| 1440 | 59231 | 59276 | 46 |
| 1441 | 59291 | 59413 | 123 |
| 1442 | 59413 | 59458 | 46 |
| 1443 | 59466 | 59511 | 46 |
| 1444 | 59513 | 59533 | 21 |
| 1445 | 59549 | 59764 | 216 |
| 1446 | 59762 | 59825 | 64 |
| 1447 | 59824 | 59907 | 84 |
| 1448 | 59916 | 60004 | 89 |
| 1449 | 60006 | 60030 | 25 |
| 1450 | 60027 | 60040 | 14 |
| 1451 | 60032 | 60100 | 69 |
| 1452 | 60119 | 60188 | 70 |
| 1453 | 60191 | 60227 | 37 |
| 1454 | 60220 | 60287 | 68 |
| 1455 | 60289 | 60314 | 26 |
| 1456 | 60316 | 60554 | 239 |
| 1457 | 60556 | 60575 | 20 |
| 1458 | 60579 | 60593 | 15 |
| 1459 | 60595 | 60638 | 44 |
| 1460 | 60651 | 60690 | 40 |
| 1461 | 60692 | 60724 | 33 |
| 1462 | 60716 | 60799 | 84 |
| 1463 | 60801 | 60872 | 72 |
| 1464 | 60868 | 60881 | 14 |
| 1465 | 60885 | 60912 | 28 |
| 1466 | 60961 | 61009 | 49 |
| 1467 | 61014 | 61042 | 29 |
| 1468 | 61046 | 61059 | 14 |
| 1469 | 61053 | 61066 | 14 |
| 1470 | 61061 | 61084 | 24 |
| 1471 | 61134 | 61164 | 31 |
| 1472 | 61178 | 61199 | 22 |
| 1473 | 61201 | 61229 | 29 |
| 1474 | 61258 | 61284 | 27 |

TABLE 1-continued

Regions of SEQ ID NO 1 which may be targeted using oligonucleotide of the invention

| Reg. A | Position in SEQ ID NO 1 from | to | Length |
|---|---|---|---|
| 1475 | 61286 | 61304 | 19 |
| 1476 | 61316 | 61332 | 17 |
| 1477 | 61341 | 61354 | 14 |
| 1478 | 61356 | 61383 | 28 |
| 1479 | 61407 | 61440 | 34 |
| 1480 | 61451 | 61468 | 18 |
| 1481 | 61470 | 61497 | 28 |
| 1482 | 61493 | 61506 | 14 |
| 1483 | 61499 | 61529 | 31 |
| 1484 | 61531 | 61558 | 28 |
| 1485 | 61590 | 61615 | 26 |
| 1486 | 61623 | 61640 | 18 |
| 1487 | 61673 | 61877 | 205 |
| 1488 | 61879 | 61898 | 20 |
| 1489 | 61900 | 61941 | 42 |
| 1490 | 61943 | 61962 | 20 |
| 1491 | 61964 | 61983 | 20 |
| 1492 | 62003 | 62017 | 15 |
| 1493 | 62015 | 62080 | 66 |
| 1494 | 62100 | 62124 | 25 |
| 1495 | 62133 | 62146 | 14 |
| 1496 | 62139 | 62175 | 37 |
| 1497 | 62191 | 62237 | 47 |
| 1498 | 62250 | 62270 | 21 |
| 1499 | 62283 | 62316 | 34 |
| 1500 | 62310 | 62358 | 49 |
| 1501 | 62357 | 62397 | 41 |
| 1502 | 62399 | 62413 | 15 |
| 1503 | 62415 | 62470 | 56 |
| 1504 | 62472 | 62501 | 30 |
| 1505 | 62503 | 62541 | 39 |
| 1506 | 62553 | 62609 | 57 |
| 1507 | 62611 | 62656 | 46 |
| 1508 | 62663 | 62690 | 28 |
| 1509 | 62703 | 62735 | 33 |
| 1510 | 62737 | 62759 | 23 |
| 1511 | 62765 | 62789 | 25 |
| 1512 | 62802 | 62816 | 15 |
| 1513 | 62810 | 62824 | 15 |
| 1514 | 62853 | 62868 | 16 |
| 1515 | 62864 | 62878 | 15 |
| 1516 | 62878 | 62907 | 30 |
| 1517 | 62905 | 62937 | 33 |
| 1518 | 62937 | 62951 | 15 |
| 1519 | 62943 | 62956 | 14 |
| 1520 | 62946 | 62960 | 15 |
| 1521 | 62961 | 62988 | 28 |
| 1522 | 62993 | 63006 | 14 |
| 1523 | 63005 | 63019 | 15 |
| 1524 | 63030 | 63049 | 20 |
| 1525 | 63057 | 63076 | 20 |
| 1526 | 63073 | 63088 | 16 |
| 1527 | 63078 | 63125 | 48 |
| 1528 | 63128 | 63152 | 25 |
| 1529 | 63154 | 63170 | 17 |
| 1530 | 63172 | 63196 | 25 |
| 1531 | 63185 | 63223 | 39 |
| 1532 | 63225 | 63245 | 21 |
| 1533 | 63236 | 63254 | 19 |
| 1534 | 63245 | 63261 | 17 |
| 1535 | 63263 | 63276 | 14 |
| 1536 | 63280 | 63295 | 16 |
| 1537 | 63292 | 63336 | 45 |
| 1538 | 63344 | 63368 | 25 |
| 1539 | 63369 | 63396 | 28 |
| 1540 | 63385 | 63398 | 14 |
| 1541 | 63395 | 63417 | 23 |
| 1542 | 63433 | 63451 | 19 |
| 1543 | 63440 | 63453 | 14 |
| 1544 | 63454 | 63470 | 17 |
| 1545 | 63472 | 63511 | 40 |
| 1546 | 63513 | 63539 | 27 |
| 1547 | 63547 | 63603 | 57 |
| 1548 | 63625 | 63651 | 27 |
| 1549 | 63676 | 63692 | 17 |
| 1550 | 63730 | 63746 | 17 |
| 1551 | 63759 | 63775 | 17 |
| 1552 | 63779 | 63833 | 55 |
| 1553 | 63844 | 63883 | 40 |
| 1554 | 63889 | 63907 | 19 |
| 1555 | 63910 | 63938 | 29 |
| 1556 | 63943 | 63962 | 20 |
| 1557 | 64004 | 64033 | 30 |
| 1558 | 64056 | 64087 | 32 |
| 1559 | 64112 | 64132 | 21 |
| 1560 | 64142 | 64158 | 17 |
| 1561 | 64160 | 64191 | 32 |
| 1562 | 64193 | 64209 | 17 |
| 1563 | 64214 | 64227 | 14 |
| 1564 | 64228 | 64241 | 14 |
| 1565 | 64254 | 64278 | 25 |
| 1566 | 64280 | 64298 | 19 |
| 1567 | 64300 | 64338 | 39 |
| 1568 | 64340 | 64355 | 16 |
| 1569 | 64357 | 64380 | 24 |
| 1570 | 64412 | 64434 | 23 |
| 1571 | 64438 | 64456 | 19 |
| 1572 | 64458 | 64488 | 31 |
| 1573 | 64490 | 64517 | 28 |
| 1574 | 64519 | 64538 | 20 |
| 1575 | 64552 | 64572 | 21 |
| 1576 | 64585 | 64608 | 24 |
| 1577 | 64625 | 64642 | 18 |
| 1578 | 64631 | 64644 | 14 |
| 1579 | 64644 | 64683 | 40 |
| 1580 | 64703 | 64716 | 14 |
| 1581 | 64736 | 64751 | 16 |
| 1582 | 64759 | 64773 | 15 |
| 1583 | 64775 | 64806 | 32 |
| 1584 | 64815 | 64831 | 17 |
| 1585 | 64845 | 64878 | 34 |
| 1586 | 64880 | 64904 | 25 |
| 1587 | 64915 | 64937 | 23 |
| 1588 | 64948 | 64971 | 24 |
| 1589 | 64973 | 64994 | 22 |
| 1590 | 64996 | 65017 | 22 |
| 1591 | 65019 | 65055 | 37 |
| 1592 | 65062 | 65109 | 48 |
| 1593 | 65111 | 65138 | 28 |
| 1594 | 65140 | 65179 | 40 |
| 1595 | 65181 | 65195 | 15 |
| 1596 | 65210 | 65230 | 21 |
| 1597 | 65232 | 65248 | 17 |
| 1598 | 65271 | 65296 | 26 |
| 1599 | 65298 | 65319 | 22 |
| 1600 | 65321 | 65371 | 51 |
| 1601 | 65391 | 65413 | 23 |
| 1602 | 65415 | 65436 | 22 |
| 1603 | 65436 | 65454 | 19 |
| 1604 | 65477 | 65490 | 14 |
| 1605 | 65492 | 65520 | 29 |
| 1606 | 65522 | 65552 | 31 |
| 1607 | 65554 | 65579 | 26 |
| 1608 | 65581 | 65594 | 14 |
| 1609 | 65591 | 65606 | 16 |
| 1610 | 65595 | 65616 | 22 |
| 1611 | 65618 | 65632 | 15 |
| 1612 | 65634 | 65657 | 24 |
| 1613 | 65661 | 65716 | 56 |
| 1614 | 65730 | 65747 | 18 |
| 1615 | 65748 | 65807 | 60 |
| 1616 | 65809 | 65829 | 21 |
| 1617 | 65831 | 65844 | 14 |
| 1618 | 65846 | 65859 | 14 |

TABLE 1-continued

Regions of SEQ ID NO 1 which may be targeted using oligonucleotide of the invention

| Reg. A | Position in SEQ ID NO 1 from | to | Length | Reg. A | Position in SEQ ID NO 1 from | to | Length |
|---|---|---|---|---|---|---|---|
| 1619 | 65861 | 65891 | 31 | 1691 | 68290 | 68373 | 84 |
| 1620 | 65898 | 65920 | 23 | 1692 | 68375 | 68419 | 45 |
| 1621 | 65930 | 65963 | 34 | 1693 | 68442 | 68487 | 46 |
| 1622 | 65980 | 66060 | 81 | 1694 | 68489 | 68547 | 59 |
| 1623 | 66069 | 66085 | 17 | 1695 | 68549 | 68592 | 44 |
| 1624 | 66095 | 66108 | 14 | 1696 | 68599 | 68614 | 16 |
| 1625 | 66110 | 66126 | 17 | 1697 | 68617 | 68657 | 41 |
| 1626 | 66139 | 66173 | 35 | 1698 | 68659 | 68686 | 28 |
| 1627 | 66175 | 66191 | 17 | 1699 | 68688 | 68735 | 48 |
| 1628 | 66204 | 66226 | 23 | 1700 | 68732 | 68747 | 16 |
| 1629 | 66224 | 66263 | 40 | 1701 | 68749 | 68786 | 38 |
| 1630 | 66265 | 66278 | 14 | 1702 | 68788 | 68830 | 43 |
| 1631 | 66280 | 66320 | 41 | 1703 | 68837 | 68879 | 43 |
| 1632 | 66322 | 66345 | 24 | 1704 | 68882 | 68899 | 18 |
| 1633 | 66355 | 66371 | 17 | 1705 | 68918 | 68942 | 25 |
| 1634 | 66375 | 66407 | 33 | 1706 | 68944 | 68968 | 25 |
| 1635 | 66411 | 66424 | 14 | 1707 | 68983 | 69007 | 25 |
| 1636 | 66421 | 66441 | 21 | 1708 | 69012 | 69027 | 16 |
| 1637 | 66440 | 66460 | 21 | 1709 | 69020 | 69064 | 45 |
| 1638 | 66463 | 66482 | 20 | 1710 | 69064 | 69077 | 14 |
| 1639 | 66484 | 66501 | 18 | 1711 | 69079 | 69114 | 36 |
| 1640 | 66509 | 66527 | 19 | 1712 | 69116 | 69196 | 81 |
| 1641 | 66534 | 66548 | 15 | 1713 | 69185 | 69198 | 14 |
| 1642 | 66556 | 66569 | 14 | 1714 | 69202 | 69219 | 18 |
| 1643 | 66562 | 66593 | 32 | 1715 | 69228 | 69246 | 19 |
| 1644 | 66606 | 66637 | 32 | 1716 | 69240 | 69282 | 43 |
| 1645 | 66639 | 66665 | 27 | 1717 | 69294 | 69317 | 24 |
| 1646 | 66674 | 66690 | 17 | 1718 | 69306 | 69324 | 19 |
| 1647 | 66692 | 66720 | 29 | 1719 | 69333 | 69346 | 14 |
| 1648 | 66722 | 66742 | 21 | 1720 | 69352 | 69366 | 15 |
| 1649 | 66758 | 66786 | 29 | 1721 | 69387 | 69431 | 45 |
| 1650 | 66787 | 66802 | 16 | 1722 | 69433 | 69447 | 15 |
| 1651 | 66812 | 66862 | 51 | 1723 | 69452 | 69480 | 29 |
| 1652 | 66864 | 66885 | 22 | 1724 | 69482 | 69497 | 16 |
| 1653 | 66940 | 66953 | 14 | 1725 | 69491 | 69504 | 14 |
| 1654 | 66982 | 66997 | 16 | 1726 | 69511 | 69564 | 54 |
| 1655 | 67024 | 67084 | 61 | 1727 | 69566 | 69628 | 63 |
| 1656 | 67103 | 67118 | 16 | 1728 | 69628 | 69642 | 15 |
| 1657 | 67156 | 67185 | 30 | 1729 | 69659 | 69681 | 23 |
| 1658 | 67181 | 67195 | 15 | 1730 | 69684 | 69697 | 14 |
| 1659 | 67193 | 67206 | 14 | 1731 | 69719 | 69744 | 26 |
| 1660 | 67215 | 67229 | 15 | 1732 | 69746 | 69763 | 18 |
| 1661 | 67231 | 67271 | 41 | 1733 | 69765 | 69792 | 28 |
| 1662 | 67288 | 67301 | 14 | 1734 | 69801 | 69828 | 28 |
| 1663 | 67294 | 67345 | 52 | 1735 | 69853 | 69901 | 49 |
| 1664 | 67362 | 67379 | 18 | 1736 | 69933 | 69949 | 17 |
| 1665 | 67381 | 67397 | 17 | 1737 | 69951 | 69966 | 16 |
| 1666 | 67409 | 67448 | 40 | 1738 | 69968 | 69983 | 16 |
| 1667 | 67468 | 67481 | 14 | 1739 | 69988 | 70061 | 74 |
| 1668 | 67483 | 67510 | 28 | 1740 | 70083 | 70100 | 18 |
| 1669 | 67540 | 67561 | 22 | 1741 | 70110 | 70154 | 45 |
| 1670 | 67620 | 67640 | 21 | 1742 | 70161 | 70199 | 39 |
| 1671 | 67656 | 67672 | 17 | 1743 | 70202 | 70225 | 24 |
| 1672 | 67674 | 67749 | 76 | 1744 | 70231 | 70246 | 16 |
| 1673 | 67751 | 67764 | 14 | 1745 | 70269 | 70295 | 27 |
| 1674 | 67783 | 67801 | 19 | 1746 | 70292 | 70327 | 36 |
| 1675 | 67803 | 67828 | 26 | 1747 | 70331 | 70349 | 19 |
| 1676 | 67830 | 67848 | 19 | 1748 | 70351 | 70371 | 21 |
| 1677 | 67850 | 67868 | 19 | 1749 | 70381 | 70403 | 23 |
| 1678 | 67877 | 67918 | 42 | 1750 | 70405 | 70420 | 16 |
| 1679 | 67933 | 67961 | 29 | 1751 | 70422 | 70483 | 62 |
| 1680 | 67963 | 67978 | 16 | 1752 | 70496 | 70533 | 38 |
| 1681 | 67998 | 68026 | 29 | 1753 | 70535 | 70578 | 44 |
| 1682 | 68028 | 68046 | 19 | 1754 | 70577 | 70639 | 63 |
| 1683 | 68048 | 68082 | 35 | 1755 | 70653 | 70667 | 15 |
| 1684 | 68084 | 68112 | 29 | 1756 | 70661 | 70674 | 14 |
| 1685 | 68114 | 68130 | 17 | 1757 | 70669 | 70695 | 27 |
| 1686 | 68129 | 68155 | 27 | 1758 | 70687 | 70705 | 19 |
| 1687 | 68170 | 68192 | 23 | 1759 | 70708 | 70744 | 37 |
| 1688 | 68194 | 68237 | 44 | 1760 | 70746 | 70764 | 19 |
| 1689 | 68239 | 68261 | 23 | 1761 | 70766 | 70779 | 14 |
| 1690 | 68272 | 68286 | 15 | 1762 | 70781 | 70832 | 52 |

TABLE 1-continued

Regions of SEQ ID NO 1 which may be targeted using oligonucleotide of the invention

| Reg. A | Position in SEQ ID NO 1 from | to | Length |
|---|---|---|---|
| 1763 | 70834 | 70851 | 18 |
| 1764 | 70858 | 70887 | 30 |
| 1765 | 70889 | 70902 | 14 |
| 1766 | 70920 | 70933 | 14 |
| 1767 | 70935 | 70964 | 30 |
| 1768 | 70974 | 70987 | 14 |
| 1769 | 71008 | 71028 | 21 |
| 1770 | 71030 | 71046 | 17 |
| 1771 | 71048 | 71073 | 26 |
| 1772 | 71075 | 71106 | 32 |
| 1773 | 71108 | 71133 | 26 |
| 1774 | 71137 | 71152 | 16 |
| 1775 | 71153 | 71170 | 18 |
| 1776 | 71179 | 71192 | 14 |
| 1777 | 71197 | 71224 | 28 |
| 1778 | 71235 | 71251 | 17 |
| 1779 | 71253 | 71311 | 59 |
| 1780 | 71310 | 71329 | 20 |
| 1781 | 71330 | 71364 | 35 |
| 1782 | 71366 | 71386 | 21 |
| 1783 | 71388 | 71410 | 23 |
| 1784 | 71412 | 71433 | 22 |
| 1785 | 71448 | 71472 | 25 |
| 1786 | 71475 | 71491 | 17 |
| 1787 | 71491 | 71553 | 63 |
| 1788 | 71555 | 71581 | 27 |
| 1789 | 71583 | 71624 | 42 |
| 1790 | 71634 | 71700 | 67 |
| 1791 | 71706 | 71725 | 20 |
| 1792 | 71732 | 71747 | 16 |
| 1793 | 71789 | 71804 | 16 |
| 1794 | 71810 | 71824 | 15 |
| 1795 | 71819 | 71834 | 16 |
| 1796 | 71839 | 71872 | 34 |
| 1797 | 71876 | 71889 | 14 |
| 1798 | 71886 | 71908 | 23 |
| 1799 | 71910 | 71924 | 15 |
| 1800 | 71985 | 71999 | 15 |
| 1801 | 72000 | 72021 | 22 |
| 1802 | 72023 | 72047 | 25 |
| 1803 | 72071 | 72158 | 88 |
| 1804 | 72165 | 72192 | 28 |
| 1805 | 72194 | 72234 | 41 |
| 1806 | 72236 | 72255 | 20 |
| 1807 | 72257 | 72281 | 25 |
| 1808 | 72283 | 72299 | 17 |
| 1809 | 72312 | 72329 | 18 |
| 1810 | 72323 | 72336 | 14 |
| 1811 | 72348 | 72395 | 48 |
| 1812 | 72398 | 72411 | 14 |
| 1813 | 72413 | 72455 | 43 |
| 1814 | 72470 | 72503 | 34 |
| 1815 | 72506 | 72541 | 36 |
| 1816 | 72545 | 72558 | 14 |
| 1817 | 72560 | 72586 | 27 |
| 1818 | 72583 | 72597 | 15 |
| 1819 | 72588 | 72602 | 15 |
| 1820 | 72611 | 72636 | 26 |
| 1821 | 72638 | 72688 | 51 |
| 1822 | 72696 | 72736 | 41 |
| 1823 | 72738 | 72761 | 24 |
| 1824 | 72774 | 72799 | 26 |
| 1825 | 72801 | 72886 | 86 |
| 1826 | 72888 | 72903 | 16 |
| 1827 | 72928 | 72958 | 31 |
| 1828 | 72962 | 72990 | 29 |
| 1829 | 73001 | 73014 | 14 |
| 1830 | 73017 | 73053 | 37 |
| 1831 | 73055 | 73078 | 24 |
| 1832 | 73077 | 73090 | 14 |
| 1833 | 73088 | 73121 | 34 |
| 1834 | 73124 | 73153 | 30 |
| 1835 | 73147 | 73172 | 26 |
| 1836 | 73164 | 73203 | 40 |
| 1837 | 73218 | 73257 | 40 |
| 1838 | 73260 | 73273 | 14 |
| 1839 | 73268 | 73281 | 14 |
| 1840 | 73278 | 73291 | 14 |
| 1841 | 73298 | 73313 | 16 |
| 1842 | 73451 | 73465 | 15 |
| 1843 | 73459 | 73472 | 14 |
| 1844 | 73512 | 73567 | 56 |
| 1845 | 73569 | 73611 | 43 |
| 1846 | 73614 | 73645 | 32 |
| 1847 | 73661 | 73713 | 53 |
| 1848 | 73712 | 73727 | 16 |
| 1849 | 73716 | 73731 | 16 |
| 1850 | 73735 | 73748 | 14 |
| 1851 | 73741 | 73760 | 20 |
| 1852 | 73764 | 73782 | 19 |
| 1853 | 73783 | 73801 | 19 |
| 1854 | 73795 | 73829 | 35 |
| 1855 | 73860 | 73873 | 14 |
| 1856 | 73885 | 73904 | 20 |
| 1857 | 73906 | 73919 | 14 |
| 1858 | 73916 | 73945 | 30 |
| 1859 | 73947 | 73961 | 15 |
| 1860 | 73978 | 74018 | 41 |
| 1861 | 74020 | 74046 | 27 |
| 1862 | 74061 | 74082 | 22 |
| 1863 | 74092 | 74158 | 67 |
| 1864 | 74160 | 74177 | 18 |
| 1865 | 74179 | 74209 | 31 |
| 1866 | 74216 | 74245 | 30 |
| 1867 | 74270 | 74287 | 18 |
| 1868 | 74289 | 74305 | 17 |
| 1869 | 74307 | 74368 | 62 |
| 1870 | 74369 | 74411 | 43 |
| 1871 | 74416 | 74461 | 46 |
| 1872 | 74463 | 74479 | 17 |
| 1873 | 74506 | 74541 | 36 |
| 1874 | 74543 | 74636 | 94 |
| 1875 | 74647 | 74704 | 58 |
| 1876 | 74745 | 74770 | 26 |
| 1877 | 74789 | 74813 | 25 |
| 1878 | 74815 | 74838 | 24 |
| 1879 | 74850 | 74877 | 28 |
| 1880 | 74891 | 74923 | 33 |
| 1881 | 74925 | 74940 | 16 |
| 1882 | 74952 | 74969 | 18 |
| 1883 | 74979 | 75001 | 23 |
| 1884 | 75037 | 75066 | 30 |
| 1885 | 75068 | 75088 | 21 |
| 1886 | 75097 | 75123 | 27 |
| 1887 | 75131 | 75149 | 19 |
| 1888 | 75152 | 75189 | 38 |
| 1889 | 75210 | 75252 | 43 |
| 1890 | 75254 | 75276 | 23 |
| 1891 | 75288 | 75310 | 23 |
| 1892 | 75338 | 75357 | 20 |
| 1893 | 75359 | 75372 | 14 |
| 1894 | 75376 | 75397 | 22 |
| 1895 | 75405 | 75432 | 28 |
| 1896 | 75440 | 75470 | 31 |
| 1897 | 75482 | 75501 | 20 |
| 1898 | 75503 | 75540 | 38 |
| 1899 | 75544 | 75560 | 17 |
| 1900 | 75562 | 75576 | 15 |
| 1901 | 75589 | 75610 | 22 |
| 1902 | 75633 | 75646 | 14 |
| 1903 | 75648 | 75679 | 32 |
| 1904 | 75691 | 75709 | 19 |
| 1905 | 75711 | 75724 | 14 |
| 1906 | 75740 | 75764 | 25 |

TABLE 1-continued

Regions of SEQ ID NO 1 which may be targeted using oligonucleotide of the invention

| Reg. A | Position in SEQ ID NO 1 from | to | Length |
|---|---|---|---|
| 1907 | 75763 | 75776 | 14 |
| 1908 | 75767 | 75790 | 24 |
| 1909 | 75780 | 75794 | 15 |
| 1910 | 75792 | 75808 | 17 |
| 1911 | 75810 | 75829 | 20 |
| 1912 | 75831 | 75863 | 33 |
| 1913 | 75865 | 75880 | 16 |
| 1914 | 75882 | 75922 | 41 |
| 1915 | 75932 | 75998 | 67 |
| 1916 | 76000 | 76026 | 27 |
| 1917 | 76028 | 76045 | 18 |
| 1918 | 76046 | 76082 | 37 |
| 1919 | 76098 | 76413 | 316 |
| 1920 | 76420 | 76442 | 23 |
| 1921 | 76456 | 76477 | 22 |
| 1922 | 76484 | 76558 | 75 |
| 1923 | 76573 | 76592 | 20 |
| 1924 | 76608 | 76622 | 15 |
| 1925 | 76627 | 76663 | 37 |
| 1926 | 76665 | 76683 | 19 |
| 1927 | 76685 | 76698 | 14 |
| 1928 | 76702 | 76716 | 15 |
| 1929 | 76725 | 76744 | 20 |
| 1930 | 76745 | 76761 | 17 |
| 1931 | 76780 | 76796 | 17 |
| 1932 | 76798 | 76812 | 15 |
| 1933 | 76814 | 76832 | 19 |
| 1934 | 76834 | 76859 | 26 |
| 1935 | 76871 | 76934 | 64 |
| 1936 | 77012 | 77034 | 23 |
| 1937 | 77039 | 77055 | 17 |
| 1938 | 77081 | 77094 | 14 |
| 1939 | 77121 | 77184 | 64 |
| 1940 | 77186 | 77200 | 15 |
| 1941 | 77202 | 77225 | 24 |
| 1942 | 77227 | 77247 | 21 |
| 1943 | 77261 | 77317 | 57 |
| 1944 | 77327 | 77340 | 14 |
| 1945 | 77342 | 77366 | 25 |
| 1946 | 77377 | 77394 | 18 |
| 1947 | 77396 | 77439 | 44 |
| 1948 | 77453 | 77468 | 16 |
| 1949 | 77462 | 77593 | 132 |
| 1950 | 77586 | 77599 | 14 |
| 1951 | 77595 | 77641 | 47 |
| 1952 | 77643 | 77728 | 86 |
| 1953 | 77730 | 77768 | 39 |
| 1954 | 77778 | 77816 | 39 |
| 1955 | 77818 | 77835 | 18 |
| 1956 | 77837 | 77855 | 19 |
| 1957 | 77861 | 77876 | 16 |
| 1958 | 77882 | 77898 | 17 |
| 1959 | 77900 | 77924 | 25 |
| 1960 | 77923 | 77936 | 14 |
| 1961 | 77957 | 77970 | 14 |
| 1962 | 77962 | 77985 | 24 |
| 1963 | 77994 | 78022 | 29 |
| 1964 | 78024 | 78056 | 33 |
| 1965 | 78079 | 78128 | 50 |
| 1966 | 78132 | 78158 | 27 |
| 1967 | 78173 | 78213 | 41 |
| 1968 | 78224 | 78265 | 42 |
| 1969 | 78275 | 78332 | 58 |
| 1970 | 78334 | 78440 | 107 |
| 1971 | 78442 | 78489 | 48 |
| 1972 | 78491 | 78505 | 15 |
| 1973 | 78501 | 78514 | 14 |
| 1974 | 78507 | 78537 | 31 |
| 1975 | 78557 | 78570 | 14 |
| 1976 | 78562 | 78623 | 62 |
| 1977 | 78625 | 78665 | 41 |
| 1978 | 78668 | 78684 | 17 |
| 1979 | 78686 | 78759 | 74 |
| 1980 | 78761 | 78787 | 27 |
| 1981 | 78793 | 78814 | 22 |
| 1982 | 78816 | 78854 | 39 |
| 1983 | 78847 | 78860 | 14 |
| 1984 | 78874 | 78909 | 36 |
| 1985 | 78917 | 78944 | 28 |
| 1986 | 78956 | 78978 | 23 |
| 1987 | 78991 | 79008 | 18 |
| 1988 | 79003 | 79032 | 30 |
| 1989 | 79026 | 79040 | 15 |
| 1990 | 79044 | 79072 | 29 |
| 1991 | 79098 | 79158 | 61 |
| 1992 | 79162 | 79182 | 21 |
| 1993 | 79184 | 79228 | 45 |
| 1994 | 79221 | 79235 | 15 |
| 1995 | 79230 | 79262 | 33 |
| 1996 | 79287 | 79333 | 47 |
| 1997 | 79356 | 79392 | 37 |
| 1998 | 79441 | 79476 | 36 |
| 1999 | 79488 | 79522 | 35 |
| 2000 | 79522 | 79539 | 18 |
| 2001 | 79568 | 79583 | 16 |
| 2002 | 79574 | 79601 | 28 |
| 2003 | 79603 | 79618 | 16 |
| 2004 | 79617 | 79639 | 23 |
| 2005 | 79651 | 79683 | 33 |
| 2006 | 79685 | 79724 | 40 |
| 2007 | 79721 | 79736 | 16 |
| 2008 | 79727 | 79782 | 56 |
| 2009 | 79784 | 79812 | 29 |
| 2010 | 79809 | 79834 | 26 |
| 2011 | 79841 | 79861 | 21 |
| 2012 | 79873 | 79923 | 51 |
| 2013 | 79928 | 79948 | 21 |
| 2014 | 79950 | 79986 | 37 |
| 2015 | 79993 | 80019 | 27 |
| 2016 | 80019 | 80063 | 45 |
| 2017 | 80071 | 80088 | 18 |
| 2018 | 80114 | 80160 | 47 |
| 2019 | 80154 | 80183 | 30 |
| 2020 | 80185 | 80212 | 28 |
| 2021 | 80214 | 80232 | 19 |
| 2022 | 80240 | 80266 | 27 |
| 2023 | 80293 | 80312 | 20 |
| 2024 | 80344 | 80380 | 37 |
| 2025 | 80382 | 80420 | 39 |
| 2026 | 80410 | 80423 | 14 |
| 2027 | 80417 | 80438 | 22 |
| 2028 | 80440 | 80456 | 17 |
| 2029 | 80467 | 80499 | 33 |
| 2030 | 80501 | 80527 | 27 |
| 2031 | 80532 | 80561 | 30 |
| 2032 | 80563 | 80599 | 37 |
| 2033 | 80604 | 80692 | 89 |
| 2034 | 80702 | 80737 | 36 |
| 2035 | 80739 | 80795 | 57 |
| 2036 | 80796 | 80871 | 76 |
| 2037 | 80873 | 80891 | 19 |
| 2038 | 80925 | 80961 | 37 |
| 2039 | 80963 | 80992 | 30 |
| 2040 | 81009 | 81068 | 60 |
| 2041 | 81070 | 81150 | 81 |
| 2042 | 81156 | 81199 | 44 |
| 2043 | 81201 | 81225 | 25 |
| 2044 | 81237 | 81253 | 17 |
| 2045 | 81255 | 81271 | 17 |
| 2046 | 81292 | 81351 | 60 |
| 2047 | 81353 | 81371 | 19 |
| 2048 | 81392 | 81422 | 31 |
| 2049 | 81438 | 81483 | 46 |
| 2050 | 81485 | 81503 | 19 |

TABLE 1-continued

Regions of SEQ ID NO 1 which may be targeted using oligonucleotide of the invention

| Reg. A | Position in SEQ ID NO 1 from | to | Length |
|---|---|---|---|
| 2051 | 81512 | 81526 | 15 |
| 2052 | 81532 | 81554 | 23 |
| 2053 | 81556 | 81593 | 38 |
| 2054 | 81606 | 81664 | 59 |
| 2055 | 81666 | 81698 | 33 |
| 2056 | 81701 | 81720 | 20 |
| 2057 | 81728 | 81776 | 49 |
| 2058 | 81781 | 81810 | 30 |
| 2059 | 81812 | 81847 | 36 |
| 2060 | 81849 | 81893 | 45 |
| 2061 | 81908 | 81934 | 27 |
| 2062 | 81943 | 81964 | 22 |
| 2063 | 81967 | 82034 | 68 |
| 2064 | 82036 | 82134 | 99 |
| 2065 | 82136 | 82154 | 19 |
| 2066 | 82176 | 82197 | 22 |
| 2067 | 82199 | 82250 | 52 |
| 2068 | 82252 | 82269 | 18 |
| 2069 | 82271 | 82293 | 23 |
| 2070 | 82300 | 82314 | 15 |
| 2071 | 82329 | 82343 | 15 |
| 2072 | 82344 | 82357 | 14 |
| 2073 | 82378 | 82407 | 30 |
| 2074 | 82406 | 82422 | 17 |
| 2075 | 82421 | 82443 | 23 |
| 2076 | 82446 | 82469 | 24 |
| 2077 | 82490 | 82507 | 18 |
| 2078 | 82502 | 82523 | 22 |
| 2079 | 82547 | 82576 | 30 |
| 2080 | 82590 | 82603 | 14 |
| 2081 | 82628 | 82647 | 20 |
| 2082 | 82650 | 82666 | 17 |
| 2083 | 82669 | 82683 | 15 |
| 2084 | 82685 | 82716 | 32 |
| 2085 | 82715 | 82736 | 22 |
| 2086 | 82760 | 82785 | 26 |
| 2087 | 82778 | 82791 | 14 |
| 2088 | 82780 | 82818 | 39 |
| 2089 | 82811 | 82825 | 15 |
| 2090 | 82821 | 82864 | 44 |
| 2091 | 82883 | 82915 | 33 |
| 2092 | 82919 | 82935 | 17 |
| 2093 | 82930 | 82946 | 17 |
| 2094 | 82937 | 82957 | 21 |
| 2095 | 82959 | 82972 | 14 |
| 2096 | 82974 | 83000 | 27 |
| 2097 | 83020 | 83036 | 17 |
| 2098 | 83038 | 83088 | 51 |
| 2099 | 83090 | 83115 | 26 |
| 2100 | 83120 | 83140 | 21 |
| 2101 | 83142 | 83155 | 14 |
| 2102 | 83160 | 83186 | 27 |
| 2103 | 83198 | 83215 | 18 |
| 2104 | 83227 | 83246 | 20 |
| 2105 | 83273 | 83339 | 67 |
| 2106 | 83341 | 83385 | 45 |
| 2107 | 83387 | 83400 | 14 |
| 2108 | 83413 | 83426 | 14 |
| 2109 | 83417 | 83449 | 33 |
| 2110 | 83486 | 83520 | 35 |
| 2111 | 83522 | 83565 | 44 |
| 2112 | 83567 | 83581 | 15 |
| 2113 | 83576 | 83670 | 95 |
| 2114 | 83681 | 83701 | 21 |
| 2115 | 83703 | 83716 | 14 |
| 2116 | 83733 | 83817 | 85 |
| 2117 | 83817 | 83830 | 14 |
| 2118 | 83832 | 83853 | 22 |
| 2119 | 83855 | 83871 | 17 |
| 2120 | 83886 | 83926 | 41 |
| 2121 | 83958 | 83974 | 17 |
| 2122 | 83976 | 83991 | 16 |
| 2123 | 83993 | 84031 | 39 |
| 2124 | 84033 | 84067 | 35 |
| 2125 | 84069 | 84102 | 34 |
| 2126 | 84104 | 84121 | 18 |
| 2127 | 84143 | 84233 | 91 |
| 2128 | 84249 | 84281 | 33 |
| 2129 | 84283 | 84403 | 121 |
| 2130 | 84404 | 84432 | 29 |
| 2131 | 84431 | 84444 | 14 |
| 2132 | 84434 | 84490 | 57 |
| 2133 | 84503 | 84520 | 18 |
| 2134 | 84522 | 84555 | 34 |
| 2135 | 84557 | 84572 | 16 |
| 2136 | 84574 | 84597 | 24 |
| 2137 | 84607 | 84626 | 20 |
| 2138 | 84650 | 84675 | 26 |
| 2139 | 84677 | 84700 | 24 |
| 2140 | 84721 | 84753 | 33 |
| 2141 | 84755 | 84807 | 53 |
| 2142 | 84809 | 84826 | 18 |
| 2143 | 84831 | 84849 | 19 |
| 2144 | 84879 | 84893 | 15 |
| 2145 | 84895 | 84915 | 21 |
| 2146 | 84917 | 84961 | 45 |
| 2147 | 85234 | 85247 | 14 |
| 2148 | 85253 | 85267 | 15 |
| 2149 | 85256 | 85351 | 96 |
| 2150 | 85359 | 85374 | 16 |
| 2151 | 85363 | 85376 | 14 |
| 2152 | 85365 | 85381 | 17 |
| 2153 | 85380 | 85414 | 35 |
| 2154 | 85416 | 85454 | 39 |
| 2155 | 85456 | 85484 | 29 |
| 2156 | 85509 | 85545 | 37 |
| 2157 | 85535 | 85550 | 16 |
| 2158 | 85566 | 85584 | 19 |
| 2159 | 85586 | 85610 | 25 |
| 2160 | 85604 | 85627 | 24 |
| 2161 | 85628 | 85665 | 38 |
| 2162 | 85698 | 85723 | 26 |
| 2163 | 85713 | 85728 | 16 |
| 2164 | 85722 | 85735 | 14 |
| 2165 | 85770 | 85785 | 16 |
| 2166 | 85800 | 85813 | 14 |
| 2167 | 85875 | 85888 | 14 |
| 2168 | 85950 | 85963 | 14 |
| 2169 | 86097 | 86125 | 29 |
| 2170 | 86127 | 86142 | 16 |
| 2171 | 86175 | 86198 | 24 |
| 2172 | 86226 | 86242 | 17 |
| 2173 | 86237 | 86302 | 66 |
| 2174 | 86308 | 86327 | 20 |
| 2175 | 86321 | 86334 | 14 |
| 2176 | 86329 | 86382 | 54 |
| 2177 | 86384 | 86400 | 17 |
| 2178 | 86403 | 86417 | 15 |
| 2179 | 86414 | 86437 | 24 |
| 2180 | 86439 | 86455 | 17 |
| 2181 | 86461 | 86478 | 18 |
| 2182 | 86473 | 86487 | 15 |
| 2183 | 86480 | 86517 | 38 |
| 2184 | 86517 | 86531 | 15 |
| 2185 | 86565 | 86583 | 19 |
| 2186 | 86600 | 86632 | 33 |
| 2187 | 86634 | 86651 | 18 |
| 2188 | 86653 | 86678 | 26 |
| 2189 | 86697 | 86756 | 60 |
| 2190 | 86782 | 86796 | 15 |
| 2191 | 86786 | 86809 | 24 |
| 2192 | 86811 | 86855 | 45 |
| 2193 | 86857 | 86891 | 35 |
| 2194 | 86894 | 86908 | 15 |

TABLE 1-continued

Regions of SEQ ID NO 1 which may be targeted using oligonucleotide of the invention

| Reg. A | Position in SEQ ID NO 1 from | to | Length |
|---|---|---|---|
| 2195 | 86916 | 86933 | 18 |
| 2196 | 86945 | 86959 | 15 |
| 2197 | 86951 | 86965 | 15 |
| 2198 | 86969 | 86990 | 22 |
| 2199 | 87017 | 87057 | 41 |
| 2200 | 87059 | 87073 | 15 |
| 2201 | 87062 | 87076 | 15 |
| 2202 | 87066 | 87089 | 24 |
| 2203 | 87097 | 87121 | 25 |
| 2204 | 87110 | 87134 | 25 |
| 2205 | 87130 | 87155 | 26 |
| 2206 | 87160 | 87194 | 35 |
| 2207 | 87185 | 87198 | 14 |
| 2208 | 87209 | 87260 | 52 |
| 2209 | 87257 | 87270 | 14 |
| 2210 | 87274 | 87287 | 14 |
| 2211 | 87276 | 87294 | 19 |
| 2212 | 87294 | 87328 | 35 |
| 2213 | 87317 | 87333 | 17 |
| 2214 | 87336 | 87360 | 25 |
| 2215 | 87368 | 87418 | 51 |
| 2216 | 87441 | 87460 | 20 |
| 2217 | 87462 | 87487 | 26 |
| 2218 | 87489 | 87518 | 30 |
| 2219 | 87520 | 87539 | 20 |
| 2220 | 87542 | 87570 | 29 |
| 2221 | 87572 | 87601 | 30 |
| 2222 | 87603 | 87644 | 42 |
| 2223 | 87642 | 87750 | 109 |
| 2224 | 87756 | 87776 | 21 |
| 2225 | 87778 | 87803 | 26 |
| 2226 | 87803 | 87837 | 35 |
| 2227 | 87872 | 87888 | 17 |
| 2228 | 87890 | 87917 | 28 |
| 2229 | 87949 | 87964 | 16 |
| 2230 | 87963 | 88008 | 46 |
| 2231 | 88010 | 88027 | 18 |
| 2232 | 88029 | 88046 | 18 |
| 2233 | 88048 | 88089 | 42 |
| 2234 | 88091 | 88108 | 18 |
| 2235 | 88110 | 88177 | 68 |
| 2236 | 88179 | 88192 | 14 |
| 2237 | 88194 | 88229 | 36 |
| 2238 | 88234 | 88259 | 26 |
| 2239 | 88261 | 88291 | 31 |
| 2240 | 88303 | 88328 | 26 |
| 2241 | 88328 | 88341 | 14 |
| 2242 | 88340 | 88354 | 15 |
| 2243 | 88356 | 88372 | 17 |
| 2244 | 88411 | 88446 | 36 |
| 2245 | 88448 | 88465 | 18 |
| 2246 | 88469 | 88511 | 43 |
| 2247 | 88518 | 88533 | 16 |
| 2248 | 88531 | 88557 | 27 |
| 2249 | 88547 | 88560 | 14 |
| 2250 | 88573 | 88593 | 21 |
| 2251 | 88597 | 88618 | 22 |
| 2252 | 88620 | 88690 | 71 |
| 2253 | 88692 | 88745 | 54 |
| 2254 | 88954 | 88973 | 20 |
| 2255 | 88988 | 89047 | 60 |
| 2256 | 89066 | 89091 | 26 |
| 2257 | 89098 | 89119 | 22 |
| 2258 | 89135 | 89149 | 15 |
| 2259 | 89151 | 89181 | 31 |
| 2260 | 89177 | 89193 | 17 |
| 2261 | 89223 | 89273 | 51 |
| 2262 | 89285 | 89300 | 16 |
| 2263 | 89315 | 89383 | 69 |
| 2264 | 89404 | 89442 | 39 |
| 2265 | 89444 | 89541 | 98 |
| 2266 | 89579 | 89639 | 61 |
| 2267 | 89660 | 89692 | 33 |
| 2268 | 89694 | 89741 | 48 |
| 2269 | 89773 | 89787 | 15 |
| 2270 | 89789 | 89817 | 29 |
| 2271 | 89826 | 89888 | 63 |
| 2272 | 89904 | 89922 | 19 |
| 2273 | 89937 | 89950 | 14 |
| 2274 | 89945 | 89958 | 14 |
| 2275 | 89956 | 89974 | 19 |
| 2276 | 89971 | 89985 | 15 |
| 2277 | 89979 | 89992 | 14 |
| 2278 | 89984 | 90000 | 17 |
| 2279 | 89999 | 90014 | 16 |
| 2280 | 90017 | 90041 | 25 |
| 2281 | 90036 | 90049 | 14 |
| 2282 | 90077 | 90093 | 17 |
| 2283 | 90099 | 90128 | 30 |
| 2284 | 90130 | 90155 | 26 |
| 2285 | 90157 | 90200 | 44 |
| 2286 | 90225 | 90256 | 32 |
| 2287 | 90258 | 90293 | 36 |
| 2288 | 90305 | 90318 | 14 |
| 2289 | 90320 | 90352 | 33 |
| 2290 | 90356 | 90370 | 15 |
| 2291 | 90400 | 90421 | 22 |
| 2292 | 90423 | 90461 | 39 |
| 2293 | 90464 | 90507 | 44 |
| 2294 | 90509 | 90530 | 22 |
| 2295 | 90529 | 90542 | 14 |
| 2296 | 90531 | 90567 | 37 |
| 2297 | 90569 | 90612 | 44 |
| 2298 | 90614 | 90730 | 117 |
| 2299 | 90732 | 90758 | 27 |
| 2300 | 90760 | 90885 | 126 |
| 2301 | 90887 | 90918 | 32 |
| 2302 | 90920 | 90946 | 27 |
| 2303 | 90938 | 90955 | 18 |
| 2304 | 90960 | 90973 | 14 |
| 2305 | 90965 | 90981 | 17 |
| 2306 | 90973 | 91000 | 28 |
| 2307 | 90997 | 91011 | 15 |
| 2308 | 91002 | 91019 | 18 |
| 2309 | 91059 | 91140 | 82 |
| 2310 | 91142 | 91157 | 16 |
| 2311 | 91157 | 91194 | 38 |
| 2312 | 91196 | 91231 | 36 |
| 2313 | 91233 | 91251 | 19 |
| 2314 | 91253 | 91274 | 22 |
| 2315 | 91296 | 91310 | 15 |
| 2316 | 91335 | 91367 | 33 |
| 2317 | 91406 | 91442 | 37 |
| 2318 | 91447 | 91477 | 31 |
| 2319 | 91489 | 91509 | 21 |
| 2320 | 91520 | 91621 | 102 |
| 2321 | 91623 | 91674 | 52 |
| 2322 | 91680 | 91703 | 24 |
| 2323 | 91715 | 91731 | 17 |
| 2324 | 91733 | 91771 | 39 |
| 2325 | 91773 | 91788 | 16 |
| 2326 | 91790 | 91805 | 16 |
| 2327 | 91807 | 91823 | 17 |
| 2328 | 91825 | 91859 | 35 |
| 2329 | 91861 | 91900 | 40 |
| 2330 | 91907 | 91926 | 20 |
| 2331 | 91928 | 91943 | 16 |
| 2332 | 91950 | 91980 | 31 |
| 2333 | 91982 | 91996 | 15 |
| 2334 | 91998 | 92011 | 14 |
| 2335 | 92010 | 92027 | 18 |
| 2336 | 92027 | 92067 | 41 |
| 2337 | 92069 | 92126 | 58 |
| 2338 | 92128 | 92321 | 194 |

TABLE 1-continued

Regions of SEQ ID NO 1 which may be targeted using oligonucleotide of the invention

| Reg. A | Position in SEQ ID NO 1 from | to | Length |
|---|---|---|---|
| 2339 | 92323 | 92540 | 218 |
| 2340 | 92542 | 92558 | 17 |
| 2341 | 92566 | 92684 | 119 |
| 2342 | 92686 | 92726 | 41 |
| 2343 | 92728 | 92837 | 110 |
| 2344 | 92839 | 93032 | 194 |
| 2345 | 93034 | 93094 | 61 |
| 2346 | 93100 | 93209 | 110 |
| 2347 | 93211 | 93254 | 44 |
| 2348 | 93256 | 93323 | 68 |
| 2349 | 93325 | 93448 | 124 |
| 2350 | 93459 | 93477 | 19 |
| 2351 | 93475 | 93497 | 23 |
| 2352 | 93509 | 93530 | 22 |
| 2353 | 93532 | 93566 | 35 |
| 2354 | 93568 | 93601 | 34 |
| 2355 | 93606 | 93646 | 41 |
| 2356 | 93668 | 93716 | 49 |
| 2357 | 93718 | 93742 | 25 |
| 2358 | 93744 | 93788 | 45 |
| 2359 | 93790 | 93808 | 19 |
| 2360 | 93811 | 93832 | 22 |
| 2361 | 93874 | 93901 | 28 |
| 2362 | 93904 | 93986 | 83 |
| 2363 | 94021 | 94036 | 16 |
| 2364 | 94038 | 94079 | 42 |
| 2365 | 94073 | 94086 | 14 |
| 2366 | 94097 | 94116 | 20 |
| 2367 | 94118 | 94141 | 24 |
| 2368 | 94140 | 94219 | 80 |
| 2369 | 94242 | 94257 | 16 |
| 2370 | 94264 | 94335 | 72 |
| 2371 | 94337 | 94356 | 20 |
| 2372 | 94358 | 94378 | 21 |
| 2373 | 94373 | 94386 | 14 |
| 2374 | 94384 | 94403 | 20 |
| 2375 | 94405 | 94422 | 18 |
| 2376 | 94453 | 94497 | 45 |
| 2377 | 94497 | 94558 | 62 |
| 2378 | 94560 | 94605 | 46 |
| 2379 | 94630 | 94724 | 95 |
| 2380 | 94739 | 94752 | 14 |
| 2381 | 94755 | 94786 | 32 |
| 2382 | 94800 | 94815 | 16 |
| 2383 | 94872 | 94901 | 30 |
| 2384 | 94903 | 94953 | 51 |
| 2385 | 94955 | 95060 | 106 |
| 2386 | 95070 | 95085 | 16 |
| 2387 | 95093 | 95110 | 18 |
| 2388 | 95135 | 95149 | 15 |
| 2389 | 95154 | 95168 | 15 |
| 2390 | 95170 | 95210 | 41 |
| 2391 | 95227 | 95257 | 31 |
| 2392 | 95302 | 95318 | 17 |
| 2393 | 95311 | 95356 | 46 |
| 2394 | 95359 | 95401 | 43 |
| 2395 | 95403 | 95453 | 51 |
| 2396 | 95450 | 95463 | 14 |
| 2397 | 95475 | 95491 | 17 |
| 2398 | 95503 | 95553 | 51 |
| 2399 | 95555 | 95569 | 15 |
| 2400 | 95583 | 95609 | 27 |
| 2401 | 95634 | 95668 | 35 |
| 2402 | 95718 | 95738 | 21 |
| 2403 | 95727 | 95740 | 14 |
| 2404 | 95836 | 95849 | 14 |
| 2405 | 95851 | 95872 | 22 |
| 2406 | 95874 | 95888 | 15 |
| 2407 | 95890 | 95910 | 21 |
| 2408 | 95912 | 95925 | 14 |
| 2409 | 95938 | 95969 | 32 |
| 2410 | 95973 | 95990 | 18 |
| 2411 | 95992 | 96066 | 75 |
| 2412 | 96073 | 96087 | 15 |
| 2413 | 96103 | 96120 | 18 |
| 2414 | 96122 | 96167 | 46 |
| 2415 | 96169 | 96182 | 14 |
| 2416 | 96183 | 96211 | 29 |
| 2417 | 96213 | 96234 | 22 |
| 2418 | 96246 | 96279 | 34 |
| 2419 | 96300 | 96334 | 35 |
| 2420 | 96358 | 96375 | 18 |
| 2421 | 96377 | 96398 | 22 |
| 2422 | 96424 | 96467 | 44 |
| 2423 | 96496 | 96518 | 23 |
| 2424 | 96520 | 96535 | 16 |
| 2425 | 96540 | 96566 | 27 |
| 2426 | 96572 | 96592 | 21 |
| 2427 | 96604 | 96646 | 43 |
| 2428 | 96642 | 96655 | 14 |
| 2429 | 96648 | 96667 | 20 |
| 2430 | 96681 | 96728 | 48 |
| 2431 | 96730 | 96781 | 52 |
| 2432 | 96804 | 96829 | 26 |
| 2433 | 96831 | 96879 | 49 |
| 2434 | 96887 | 96916 | 17 |
| 2435 | 96928 | 96944 | 30 |
| 2436 | 96946 | 96959 | 14 |
| 2437 | 96970 | 96990 | 21 |
| 2438 | 96992 | 97021 | 30 |
| 2439 | 97023 | 97037 | 15 |
| 2440 | 97039 | 97073 | 35 |
| 2441 | 97075 | 97366 | 292 |
| 2442 | 97368 | 97393 | 26 |
| 2443 | 97420 | 97466 | 47 |
| 2444 | 97469 | 97507 | 39 |
| 2445 | 97513 | 97529 | 17 |
| 2446 | 97531 | 97583 | 53 |
| 2447 | 97585 | 97600 | 16 |
| 2448 | 97602 | 97631 | 30 |
| 2449 | 97633 | 97683 | 51 |
| 2450 | 97685 | 97703 | 19 |
| 2451 | 97705 | 97742 | 38 |
| 2452 | 97787 | 97803 | 17 |
| 2453 | 97805 | 97822 | 18 |
| 2454 | 97824 | 97876 | 53 |
| 2455 | 97878 | 97921 | 44 |
| 2456 | 97923 | 97943 | 21 |
| 2457 | 97945 | 97963 | 19 |
| 2458 | 97965 | 97994 | 30 |
| 2459 | 97995 | 98011 | 17 |
| 2460 | 98014 | 98044 | 31 |
| 2461 | 98039 | 98061 | 23 |
| 2462 | 98055 | 98076 | 22 |
| 2463 | 98077 | 98090 | 14 |
| 2464 | 98079 | 98092 | 14 |
| 2465 | 98085 | 98098 | 14 |
| 2466 | 98100 | 98115 | 16 |
| 2467 | 98113 | 98145 | 33 |
| 2468 | 98142 | 98160 | 19 |
| 2469 | 98162 | 98180 | 19 |
| 2470 | 98188 | 98219 | 32 |
| 2471 | 98215 | 98237 | 23 |
| 2472 | 98227 | 98240 | 14 |
| 2473 | 98232 | 98255 | 24 |
| 2474 | 98255 | 98268 | 14 |
| 2475 | 98264 | 98287 | 24 |
| 2476 | 98292 | 98326 | 35 |
| 2477 | 98373 | 98397 | 25 |
| 2478 | 98399 | 98428 | 30 |
| 2479 | 98442 | 98461 | 20 |
| 2480 | 98480 | 98501 | 22 |
| 2481 | 98499 | 98520 | 22 |
| 2482 | 98524 | 98538 | 15 |

TABLE 1-continued

Regions of SEQ ID NO 1 which may be targeted using oligonucleotide of the invention

| Reg. A | Position in SEQ ID NO 1 from | Position in SEQ ID NO 1 to | Length |
|---|---|---|---|
| 2483 | 98537 | 98550 | 14 |
| 2484 | 98545 | 98585 | 41 |
| 2485 | 98595 | 98610 | 16 |
| 2486 | 98599 | 98624 | 26 |
| 2487 | 98644 | 98668 | 25 |
| 2488 | 98678 | 98704 | 27 |
| 2489 | 98703 | 98718 | 16 |
| 2490 | 98736 | 98754 | 19 |
| 2491 | 98778 | 98794 | 17 |
| 2492 | 98802 | 98821 | 20 |
| 2493 | 98845 | 98876 | 32 |
| 2494 | 98878 | 98900 | 23 |
| 2495 | 98900 | 98972 | 73 |
| 2496 | 98961 | 98976 | 16 |
| 2497 | 98974 | 98998 | 25 |
| 2498 | 99011 | 99029 | 19 |
| 2499 | 99033 | 99065 | 33 |
| 2500 | 99067 | 99107 | 41 |
| 2501 | 99151 | 99186 | 36 |
| 2502 | 99188 | 99219 | 32 |
| 2503 | 99222 | 99245 | 24 |
| 2504 | 99254 | 99276 | 23 |
| 2505 | 99288 | 99312 | 25 |
| 2506 | 99314 | 99338 | 25 |
| 2507 | 99367 | 99430 | 64 |
| 2508 | 99444 | 99491 | 48 |
| 2509 | 99496 | 99554 | 59 |
| 2510 | 99570 | 99585 | 16 |
| 2511 | 99587 | 99618 | 32 |
| 2512 | 99620 | 99669 | 50 |
| 2513 | 99679 | 99710 | 32 |
| 2514 | 99720 | 99748 | 29 |
| 2515 | 99750 | 99763 | 14 |
| 2516 | 99768 | 99805 | 38 |
| 2517 | 99818 | 99841 | 24 |
| 2518 | 99855 | 99879 | 25 |
| 2519 | 99881 | 99900 | 20 |
| 2520 | 99902 | 99932 | 31 |
| 2521 | 99934 | 99954 | 21 |
| 2522 | 99959 | 100011 | 53 |
| 2523 | 100011 | 100037 | 27 |
| 2524 | 100057 | 100071 | 15 |
| 2525 | 100073 | 100102 | 30 |
| 2526 | 100104 | 100118 | 15 |
| 2527 | 100131 | 100186 | 56 |
| 2528 | 100188 | 100201 | 14 |
| 2529 | 100194 | 100212 | 19 |
| 2530 | 100214 | 100277 | 64 |
| 2531 | 100279 | 100303 | 25 |
| 2532 | 100309 | 100355 | 47 |
| 2533 | 100349 | 100386 | 38 |
| 2534 | 100379 | 100393 | 15 |
| 2535 | 100388 | 100401 | 14 |
| 2536 | 100403 | 100423 | 21 |
| 2537 | 100452 | 100473 | 22 |
| 2538 | 100508 | 100542 | 35 |
| 2539 | 100548 | 100580 | 33 |
| 2540 | 100582 | 100612 | 31 |
| 2541 | 100614 | 100652 | 39 |
| 2542 | 100695 | 100714 | 20 |
| 2543 | 100736 | 100749 | 14 |
| 2544 | 100751 | 100790 | 40 |
| 2545 | 100808 | 100842 | 35 |
| 2546 | 100844 | 100860 | 17 |
| 2547 | 100862 | 100930 | 69 |
| 2548 | 100939 | 100953 | 15 |
| 2549 | 100955 | 100971 | 17 |
| 2550 | 100973 | 101003 | 31 |
| 2551 | 101021 | 101048 | 28 |
| 2552 | 101057 | 101093 | 37 |
| 2553 | 101109 | 101148 | 40 |
| 2554 | 101145 | 101189 | 45 |
| 2555 | 101194 | 101208 | 15 |
| 2556 | 101210 | 101244 | 35 |
| 2557 | 101256 | 101271 | 16 |
| 2558 | 101277 | 101300 | 24 |
| 2559 | 101310 | 101327 | 18 |
| 2560 | 101329 | 101345 | 17 |
| 2561 | 101374 | 101397 | 24 |
| 2562 | 101409 | 101426 | 18 |
| 2563 | 101453 | 101466 | 14 |
| 2564 | 101474 | 101487 | 14 |
| 2565 | 101481 | 101515 | 35 |
| 2566 | 101518 | 101541 | 24 |
| 2567 | 101542 | 101560 | 19 |
| 2568 | 101554 | 101591 | 38 |
| 2569 | 101593 | 101609 | 17 |
| 2570 | 101635 | 101695 | 61 |
| 2571 | 101707 | 101746 | 40 |
| 2572 | 101748 | 101763 | 16 |
| 2573 | 101774 | 101810 | 37 |
| 2574 | 101812 | 101828 | 17 |
| 2575 | 101819 | 101835 | 17 |
| 2576 | 101829 | 101842 | 14 |
| 2577 | 101842 | 101855 | 14 |
| 2578 | 101857 | 101878 | 22 |
| 2579 | 101880 | 101943 | 64 |
| 2580 | 101947 | 101981 | 35 |
| 2581 | 101988 | 102009 | 22 |
| 2582 | 102022 | 102066 | 45 |
| 2583 | 102068 | 102084 | 17 |
| 2584 | 102100 | 102113 | 14 |
| 2585 | 102115 | 102130 | 16 |
| 2586 | 102132 | 102145 | 14 |
| 2587 | 102192 | 102241 | 50 |
| 2588 | 102269 | 102285 | 17 |
| 2589 | 102312 | 102327 | 16 |
| 2590 | 102357 | 102392 | 36 |
| 2591 | 102407 | 102428 | 22 |
| 2592 | 102430 | 102444 | 15 |
| 2593 | 102460 | 102485 | 26 |
| 2594 | 102487 | 102508 | 22 |
| 2595 | 102532 | 102573 | 42 |
| 2596 | 102595 | 102642 | 48 |
| 2597 | 102653 | 102694 | 42 |
| 2598 | 102701 | 102718 | 18 |
| 2599 | 102720 | 102734 | 15 |
| 2600 | 102736 | 102757 | 22 |
| 2601 | 102799 | 102836 | 38 |
| 2602 | 102847 | 102882 | 36 |
| 2603 | 102890 | 102927 | 38 |
| 2604 | 102938 | 102971 | 34 |
| 2605 | 102982 | 103019 | 38 |
| 2606 | 103014 | 103027 | 14 |
| 2607 | 103027 | 103054 | 28 |
| 2608 | 103065 | 103088 | 24 |
| 2609 | 103090 | 103108 | 19 |
| 2610 | 103098 | 103112 | 15 |
| 2611 | 103117 | 103138 | 22 |
| 2612 | 103152 | 103170 | 19 |
| 2613 | 103174 | 103204 | 31 |
| 2614 | 103206 | 103234 | 29 |
| 2615 | 103240 | 103268 | 29 |
| 2616 | 103286 | 103325 | 40 |
| 2617 | 103327 | 103347 | 21 |
| 2618 | 103349 | 103384 | 36 |
| 2619 | 103386 | 103405 | 20 |
| 2620 | 103422 | 103449 | 28 |
| 2621 | 103451 | 103493 | 43 |
| 2622 | 103495 | 103509 | 15 |
| 2623 | 103511 | 103560 | 50 |
| 2624 | 103565 | 103582 | 18 |
| 2625 | 103585 | 103607 | 23 |
| 2626 | 103631 | 103645 | 15 |

TABLE 1-continued

Regions of SEQ ID NO 1 which may be targeted using oligonucleotide of the invention

| Reg. A | Position in SEQ ID NO 1 from | to | Length |
|---|---|---|---|
| 2627 | 103653 | 103684 | 32 |
| 2628 | 103683 | 103696 | 14 |
| 2629 | 103691 | 103733 | 43 |
| 2630 | 103738 | 103762 | 25 |
| 2631 | 103752 | 103765 | 14 |
| 2632 | 103755 | 103768 | 14 |
| 2633 | 103758 | 103771 | 14 |
| 2634 | 103790 | 103814 | 25 |
| 2635 | 103803 | 103816 | 14 |
| 2636 | 103830 | 103865 | 36 |
| 2637 | 103900 | 103923 | 24 |
| 2638 | 103912 | 103933 | 22 |
| 2639 | 103945 | 103964 | 20 |
| 2640 | 103990 | 104005 | 16 |
| 2641 | 104024 | 104055 | 32 |
| 2642 | 104058 | 104077 | 20 |
| 2643 | 104086 | 104099 | 14 |
| 2644 | 104095 | 104122 | 28 |
| 2645 | 104124 | 104146 | 23 |
| 2646 | 104148 | 104168 | 21 |
| 2647 | 104162 | 104176 | 15 |
| 2648 | 104173 | 104187 | 15 |
| 2649 | 104201 | 104241 | 41 |
| 2650 | 104234 | 104266 | 33 |
| 2651 | 104268 | 104286 | 19 |
| 2652 | 104288 | 104302 | 15 |
| 2653 | 104304 | 104335 | 32 |
| 2654 | 104340 | 104354 | 15 |
| 2655 | 104356 | 104373 | 18 |
| 2656 | 104375 | 104391 | 17 |
| 2657 | 104393 | 104417 | 25 |
| 2658 | 104426 | 104439 | 14 |
| 2659 | 104448 | 104478 | 31 |
| 2660 | 104480 | 104504 | 25 |
| 2661 | 104519 | 104546 | 28 |
| 2662 | 104549 | 104580 | 32 |
| 2663 | 104604 | 104620 | 17 |
| 2664 | 104620 | 104646 | 27 |
| 2665 | 104654 | 104673 | 20 |
| 2666 | 104675 | 104691 | 17 |
| 2667 | 104689 | 104776 | 88 |
| 2668 | 104829 | 104842 | 14 |
| 2669 | 104838 | 104852 | 15 |
| 2670 | 104934 | 104952 | 19 |
| 2671 | 104956 | 104987 | 32 |
| 2672 | 104993 | 105045 | 53 |
| 2673 | 105041 | 105055 | 15 |
| 2674 | 105047 | 105078 | 32 |
| 2675 | 105090 | 105107 | 18 |
| 2676 | 105101 | 105115 | 15 |
| 2677 | 105109 | 105137 | 29 |
| 2678 | 105149 | 105167 | 19 |
| 2679 | 105163 | 105176 | 14 |
| 2680 | 105185 | 105237 | 53 |
| 2681 | 105230 | 105243 | 14 |
| 2682 | 105233 | 105250 | 18 |
| 2683 | 105260 | 105286 | 27 |
| 2684 | 105288 | 105340 | 53 |
| 2685 | 105345 | 105370 | 26 |
| 2686 | 105372 | 105402 | 31 |
| 2687 | 105441 | 105458 | 18 |
| 2688 | 105460 | 105521 | 62 |
| 2689 | 105526 | 105541 | 16 |
| 2690 | 105543 | 105560 | 18 |
| 2691 | 105562 | 105575 | 14 |
| 2692 | 105582 | 105606 | 25 |
| 2693 | 105616 | 105671 | 56 |
| 2694 | 105677 | 105704 | 28 |
| 2695 | 105703 | 105725 | 23 |
| 2696 | 105746 | 105759 | 14 |
| 2697 | 105750 | 105765 | 16 |
| 2698 | 105776 | 105796 | 21 |
| 2699 | 105798 | 105824 | 27 |
| 2700 | 105827 | 105907 | 81 |
| 2701 | 105924 | 105939 | 16 |
| 2702 | 105941 | 105963 | 23 |
| 2703 | 105990 | 106014 | 25 |
| 2704 | 106017 | 106048 | 32 |
| 2705 | 106039 | 106072 | 34 |
| 2706 | 106061 | 106074 | 14 |
| 2707 | 106073 | 106102 | 30 |
| 2708 | 106092 | 106107 | 16 |
| 2709 | 106114 | 106159 | 46 |
| 2710 | 106161 | 106180 | 20 |
| 2711 | 106197 | 106243 | 47 |
| 2712 | 106237 | 106250 | 14 |
| 2713 | 106243 | 106256 | 14 |
| 2714 | 106247 | 106267 | 21 |
| 2715 | 106273 | 106333 | 61 |
| 2716 | 106335 | 106367 | 33 |
| 2717 | 106369 | 106417 | 49 |
| 2718 | 106419 | 106471 | 53 |
| 2719 | 106486 | 106523 | 38 |
| 2720 | 106525 | 106538 | 14 |
| 2721 | 106552 | 106572 | 21 |
| 2722 | 106584 | 106598 | 15 |
| 2723 | 106609 | 106696 | 88 |
| 2724 | 106698 | 106723 | 26 |
| 2725 | 106725 | 106740 | 16 |
| 2726 | 106743 | 106781 | 39 |
| 2727 | 106783 | 106811 | 29 |
| 2728 | 106826 | 106866 | 41 |
| 2729 | 106875 | 106902 | 28 |
| 2730 | 106916 | 106935 | 20 |
| 2731 | 106942 | 106960 | 19 |
| 2732 | 106991 | 107010 | 20 |
| 2733 | 107019 | 107038 | 20 |
| 2734 | 107040 | 107072 | 33 |
| 2735 | 107079 | 107094 | 16 |
| 2736 | 107087 | 107101 | 15 |
| 2737 | 107090 | 107109 | 20 |
| 2738 | 107113 | 107127 | 15 |
| 2739 | 107129 | 107143 | 15 |
| 2740 | 107154 | 107172 | 19 |
| 2741 | 107174 | 107198 | 25 |
| 2742 | 107210 | 107226 | 17 |
| 2743 | 107226 | 107239 | 14 |
| 2744 | 107237 | 107274 | 38 |
| 2745 | 107296 | 107356 | 61 |
| 2746 | 107358 | 107381 | 24 |
| 2747 | 107383 | 107415 | 33 |
| 2748 | 107417 | 107433 | 17 |
| 2749 | 107435 | 107455 | 21 |
| 2750 | 107457 | 107508 | 52 |
| 2751 | 107510 | 107525 | 16 |
| 2752 | 107527 | 107546 | 20 |
| 2753 | 107559 | 107573 | 15 |
| 2754 | 107586 | 107617 | 32 |
| 2755 | 107643 | 107689 | 47 |
| 2756 | 107694 | 107716 | 23 |
| 2757 | 107744 | 107792 | 49 |
| 2758 | 107790 | 107832 | 43 |
| 2759 | 107834 | 107860 | 27 |
| 2760 | 107864 | 107896 | 33 |
| 2761 | 107898 | 107912 | 15 |
| 2762 | 107914 | 107953 | 40 |
| 2763 | 107967 | 107992 | 26 |
| 2764 | 107994 | 108008 | 15 |
| 2765 | 108010 | 108038 | 29 |
| 2766 | 108065 | 108084 | 20 |
| 2767 | 108113 | 108215 | 103 |
| 2768 | 108220 | 108249 | 30 |
| 2769 | 108253 | 108281 | 29 |
| 2770 | 108283 | 108304 | 22 |

TABLE 1-continued

Regions of SEQ ID NO 1 which may be targeted using oligonucleotide of the invention

| Reg. A | Position in SEQ ID NO 1 from | to | Length |
|---|---|---|---|
| 2771 | 108317 | 108359 | 43 |
| 2772 | 108361 | 108375 | 15 |
| 2773 | 108386 | 108402 | 17 |
| 2774 | 108421 | 108440 | 20 |
| 2775 | 108538 | 108551 | 14 |
| 2776 | 108561 | 108575 | 15 |
| 2777 | 108577 | 108616 | 40 |
| 2778 | 108618 | 108665 | 48 |
| 2779 | 108677 | 108707 | 31 |
| 2780 | 108735 | 108768 | 34 |
| 2781 | 108762 | 108777 | 16 |
| 2782 | 108780 | 108824 | 45 |
| 2783 | 108842 | 108885 | 44 |
| 2784 | 108907 | 108970 | 64 |
| 2785 | 108983 | 109019 | 37 |
| 2786 | 109021 | 109053 | 33 |
| 2787 | 109055 | 109068 | 14 |
| 2788 | 109070 | 109099 | 30 |
| 2789 | 109097 | 109122 | 26 |
| 2790 | 109113 | 109132 | 20 |
| 2791 | 109125 | 109165 | 41 |
| 2792 | 109167 | 109181 | 15 |
| 2793 | 109183 | 109200 | 18 |
| 2794 | 109214 | 109248 | 35 |
| 2795 | 109256 | 109277 | 22 |
| 2796 | 109281 | 109298 | 18 |
| 2797 | 109298 | 109311 | 14 |
| 2798 | 109300 | 109318 | 19 |
| 2799 | 109324 | 109374 | 51 |
| 2800 | 109377 | 109397 | 21 |
| 2801 | 109399 | 109437 | 39 |
| 2802 | 109446 | 109461 | 16 |
| 2803 | 109463 | 109476 | 14 |
| 2804 | 109472 | 109485 | 14 |
| 2805 | 109478 | 109514 | 37 |
| 2806 | 109516 | 109540 | 25 |
| 2807 | 109556 | 109588 | 33 |
| 2808 | 109601 | 109644 | 44 |
| 2809 | 109661 | 109681 | 21 |
| 2810 | 109683 | 109709 | 27 |
| 2811 | 109707 | 109737 | 31 |
| 2812 | 109739 | 109754 | 16 |
| 2813 | 109754 | 109768 | 15 |
| 2814 | 109770 | 109798 | 29 |
| 2815 | 109810 | 109829 | 20 |
| 2816 | 109859 | 109877 | 19 |
| 2817 | 109879 | 109934 | 56 |
| 2818 | 109955 | 109975 | 21 |
| 2819 | 109975 | 109988 | 14 |
| 2820 | 109994 | 110096 | 103 |
| 2821 | 110103 | 110129 | 27 |
| 2822 | 110131 | 110152 | 22 |
| 2823 | 110153 | 110173 | 21 |
| 2824 | 110175 | 110195 | 21 |
| 2825 | 110192 | 110226 | 35 |
| 2826 | 110297 | 110312 | 16 |
| 2827 | 110301 | 110314 | 14 |
| 2828 | 110308 | 110333 | 26 |
| 2829 | 110335 | 110351 | 17 |
| 2830 | 110353 | 110368 | 16 |
| 2831 | 110376 | 110401 | 26 |
| 2832 | 110418 | 110462 | 45 |
| 2833 | 110464 | 110481 | 18 |
| 2834 | 110531 | 110558 | 28 |
| 2835 | 110571 | 110590 | 20 |
| 2836 | 110599 | 110639 | 41 |
| 2837 | 110630 | 110643 | 14 |
| 2838 | 110641 | 110661 | 21 |
| 2839 | 110668 | 110681 | 14 |
| 2840 | 110683 | 110709 | 27 |
| 2841 | 110717 | 110798 | 82 |
| 2842 | 110804 | 110849 | 46 |
| 2843 | 110853 | 110890 | 38 |
| 2844 | 110928 | 110966 | 39 |
| 2845 | 110971 | 111003 | 33 |
| 2846 | 111000 | 111013 | 14 |
| 2847 | 111015 | 111033 | 19 |
| 2848 | 111035 | 111050 | 16 |
| 2849 | 111062 | 111094 | 33 |
| 2850 | 111092 | 111105 | 14 |
| 2851 | 111107 | 111140 | 34 |
| 2852 | 111161 | 111203 | 43 |
| 2853 | 111209 | 111223 | 15 |
| 2854 | 111224 | 111280 | 57 |
| 2855 | 111275 | 111290 | 16 |
| 2856 | 111283 | 111303 | 21 |
| 2857 | 111305 | 111320 | 16 |
| 2858 | 111311 | 111347 | 37 |
| 2859 | 111355 | 111368 | 14 |
| 2860 | 111357 | 111371 | 15 |
| 2861 | 111360 | 111381 | 22 |
| 2862 | 111373 | 111421 | 49 |
| 2863 | 111412 | 111426 | 15 |
| 2864 | 111451 | 111468 | 18 |
| 2865 | 111467 | 111480 | 14 |
| 2866 | 111482 | 111496 | 15 |
| 2867 | 111486 | 111500 | 15 |
| 2868 | 111497 | 111510 | 14 |
| 2869 | 111531 | 111564 | 34 |
| 2870 | 111580 | 111606 | 27 |
| 2871 | 111616 | 111637 | 22 |
| 2872 | 111658 | 111671 | 14 |
| 2873 | 111674 | 111688 | 15 |
| 2874 | 111692 | 111710 | 19 |
| 2875 | 111712 | 111725 | 14 |
| 2876 | 111727 | 111761 | 35 |
| 2877 | 111781 | 111804 | 24 |
| 2878 | 111811 | 111828 | 18 |
| 2879 | 111831 | 111849 | 19 |
| 2880 | 111856 | 111871 | 16 |
| 2881 | 111901 | 111917 | 17 |
| 2882 | 111919 | 111940 | 22 |
| 2883 | 111942 | 111987 | 46 |
| 2884 | 111984 | 112002 | 19 |
| 2885 | 112004 | 112069 | 66 |
| 2886 | 112070 | 112091 | 22 |
| 2887 | 112093 | 112116 | 24 |
| 2888 | 112118 | 112132 | 15 |
| 2889 | 112139 | 112170 | 32 |
| 2890 | 112180 | 112196 | 17 |
| 2891 | 112204 | 112223 | 20 |
| 2892 | 112236 | 112283 | 48 |
| 2893 | 112329 | 112343 | 15 |
| 2894 | 112345 | 112383 | 39 |
| 2895 | 112385 | 112401 | 17 |
| 2896 | 112404 | 112423 | 20 |
| 2897 | 112463 | 112477 | 15 |
| 2898 | 112485 | 112547 | 63 |
| 2899 | 112563 | 112581 | 19 |
| 2900 | 112583 | 112597 | 15 |
| 2901 | 112607 | 112638 | 32 |
| 2902 | 112640 | 112664 | 25 |
| 2903 | 112683 | 112721 | 39 |
| 2904 | 112730 | 112759 | 30 |
| 2905 | 112773 | 112811 | 39 |
| 2906 | 112811 | 112825 | 15 |
| 2907 | 112828 | 112862 | 35 |
| 2908 | 112882 | 112912 | 31 |
| 2909 | 112914 | 112967 | 54 |
| 2910 | 112968 | 112982 | 15 |
| 2911 | 112984 | 113016 | 33 |
| 2912 | 113044 | 113064 | 21 |
| 2913 | 113074 | 113097 | 24 |
| 2914 | 113111 | 113153 | 43 |

TABLE 1-continued

Regions of SEQ ID NO 1 which may be targeted using oligonucleotide of the invention

| Reg. A | Position in SEQ ID NO 1 from | to | Length |
|---|---|---|---|
| 2915 | 113169 | 113194 | 26 |
| 2916 | 113198 | 113212 | 15 |
| 2917 | 113214 | 113230 | 17 |
| 2918 | 113232 | 113263 | 32 |
| 2919 | 113265 | 113284 | 20 |
| 2920 | 113306 | 113328 | 23 |
| 2921 | 113330 | 113355 | 26 |
| 2922 | 113357 | 113371 | 15 |
| 2923 | 113404 | 113422 | 19 |
| 2924 | 113421 | 113489 | 69 |
| 2925 | 113533 | 113559 | 27 |
| 2926 | 113561 | 113574 | 14 |
| 2927 | 113595 | 113616 | 22 |
| 2928 | 113648 | 113700 | 53 |
| 2929 | 113702 | 113739 | 38 |
| 2930 | 113762 | 113823 | 62 |
| 2931 | 113825 | 113960 | 136 |
| 2932 | 113962 | 114015 | 54 |
| 2933 | 114017 | 114048 | 32 |
| 2934 | 114045 | 114124 | 80 |
| 2935 | 114151 | 114170 | 20 |
| 2936 | 114182 | 114218 | 37 |
| 2937 | 114230 | 114270 | 41 |
| 2938 | 114272 | 114292 | 21 |
| 2939 | 114296 | 114339 | 44 |
| 2940 | 114354 | 114433 | 80 |
| 2941 | 114440 | 114457 | 18 |
| 2942 | 114459 | 114484 | 26 |
| 2943 | 114478 | 114536 | 59 |
| 2944 | 114538 | 114559 | 22 |
| 2945 | 114567 | 114592 | 26 |
| 2946 | 114594 | 114610 | 17 |
| 2947 | 114612 | 114652 | 41 |
| 2948 | 114681 | 114752 | 72 |
| 2949 | 114775 | 114805 | 31 |
| 2950 | 114803 | 114816 | 14 |
| 2951 | 114807 | 114821 | 15 |
| 2952 | 114823 | 114847 | 25 |
| 2953 | 114868 | 114912 | 45 |
| 2954 | 114947 | 114961 | 15 |
| 2955 | 114974 | 114997 | 24 |
| 2956 | 115001 | 115015 | 15 |
| 2957 | 115004 | 115017 | 14 |
| 2958 | 115019 | 115069 | 51 |
| 2959 | 115060 | 115073 | 14 |
| 2960 | 115072 | 115085 | 14 |
| 2961 | 115087 | 115100 | 14 |
| 2962 | 115102 | 115124 | 23 |
| 2963 | 115132 | 115151 | 20 |
| 2964 | 115154 | 115168 | 15 |
| 2965 | 115188 | 115208 | 21 |
| 2966 | 115219 | 115256 | 38 |
| 2967 | 115258 | 115283 | 26 |
| 2968 | 115285 | 115300 | 16 |
| 2969 | 115331 | 115353 | 23 |
| 2970 | 115355 | 115372 | 18 |
| 2971 | 115380 | 115397 | 18 |
| 2972 | 115399 | 115412 | 14 |
| 2973 | 115426 | 115475 | 50 |
| 2974 | 115496 | 115510 | 15 |
| 2975 | 115521 | 115545 | 25 |
| 2976 | 115555 | 115580 | 26 |
| 2977 | 115582 | 115600 | 19 |
| 2978 | 115602 | 115621 | 20 |
| 2979 | 115653 | 115677 | 25 |
| 2980 | 115692 | 115720 | 29 |
| 2981 | 115722 | 115738 | 17 |
| 2982 | 115769 | 115783 | 15 |
| 2983 | 115792 | 115808 | 17 |
| 2984 | 115819 | 115837 | 19 |
| 2985 | 115846 | 115878 | 33 |
| 2986 | 115888 | 115901 | 14 |

TABLE 1-continued

Regions of SEQ ID NO 1 which may be targeted using oligonucleotide of the invention

| Reg. A | Position in SEQ ID NO 1 from | to | Length |
|---|---|---|---|
| 2987 | 115916 | 115932 | 17 |
| 2988 | 115943 | 115956 | 14 |
| 2989 | 115967 | 115993 | 27 |
| 2990 | 115996 | 116014 | 19 |
| 2991 | 116027 | 116045 | 19 |
| 2992 | 116105 | 116127 | 23 |
| 2993 | 116126 | 116139 | 14 |
| 2994 | 116141 | 116158 | 18 |
| 2995 | 116171 | 116186 | 16 |
| 2996 | 116194 | 116208 | 15 |
| 2997 | 116257 | 116279 | 23 |
| 2998 | 116318 | 116373 | 56 |
| 2999 | 116375 | 116437 | 63 |
| 3000 | 116439 | 116454 | 16 |
| 3001 | 116456 | 116496 | 41 |
| 3002 | 116500 | 116532 | 33 |
| 3003 | 116534 | 116554 | 21 |
| 3004 | 116556 | 116573 | 18 |
| 3005 | 116575 | 116592 | 18 |
| 3006 | 116596 | 116615 | 20 |
| 3007 | 116617 | 116650 | 34 |
| 3008 | 116650 | 116664 | 15 |
| 3009 | 116666 | 116694 | 29 |
| 3010 | 116775 | 116792 | 18 |
| 3011 | 116794 | 116811 | 18 |
| 3012 | 116813 | 116838 | 26 |
| 3013 | 116840 | 116872 | 33 |
| 3014 | 116890 | 116911 | 22 |
| 3015 | 116921 | 116948 | 28 |
| 3016 | 116952 | 116988 | 37 |
| 3017 | 116990 | 117006 | 17 |
| 3018 | 117008 | 117036 | 29 |
| 3019 | 117059 | 117133 | 75 |
| 3020 | 117187 | 117207 | 21 |
| 3021 | 117204 | 117217 | 14 |
| 3022 | 117209 | 117237 | 29 |
| 3023 | 117239 | 117252 | 14 |
| 3024 | 117255 | 117275 | 21 |
| 3025 | 117277 | 117300 | 24 |
| 3026 | 117337 | 117371 | 35 |
| 3027 | 117373 | 117416 | 44 |
| 3028 | 117418 | 117450 | 33 |
| 3029 | 117456 | 117507 | 52 |
| 3030 | 117518 | 117532 | 15 |
| 3031 | 117534 | 117590 | 57 |
| 3032 | 117582 | 117604 | 23 |
| 3033 | 117593 | 117617 | 25 |
| 3034 | 117621 | 117648 | 28 |
| 3035 | 117640 | 117662 | 23 |
| 3036 | 117664 | 117688 | 25 |
| 3037 | 117690 | 117711 | 22 |
| 3038 | 117728 | 117743 | 16 |
| 3039 | 117747 | 117781 | 35 |
| 3040 | 117784 | 117801 | 18 |
| 3041 | 117792 | 117822 | 31 |
| 3042 | 117824 | 117842 | 19 |
| 3043 | 117850 | 117869 | 20 |
| 3044 | 117890 | 117940 | 51 |
| 3045 | 117936 | 117968 | 33 |
| 3046 | 117970 | 117990 | 21 |
| 3047 | 117989 | 118034 | 46 |
| 3048 | 118034 | 118057 | 24 |
| 3049 | 118061 | 118083 | 23 |
| 3050 | 118086 | 118122 | 37 |
| 3051 | 118122 | 118182 | 61 |
| 3052 | 118172 | 118186 | 15 |
| 3053 | 118197 | 118211 | 15 |
| 3054 | 118216 | 118275 | 60 |
| 3055 | 118291 | 118316 | 26 |
| 3056 | 118318 | 118354 | 37 |
| 3057 | 118373 | 118388 | 16 |
| 3058 | 118391 | 118405 | 15 |

TABLE 1-continued

Regions of SEQ ID NO 1 which may be targeted using oligonucleotide of the invention

| Reg. A | Position in SEQ ID NO 1 from | to | Length |
|---|---|---|---|
| 3059 | 118407 | 118423 | 17 |
| 3060 | 118425 | 118456 | 32 |
| 3061 | 118465 | 118492 | 28 |
| 3062 | 118498 | 118521 | 24 |
| 3063 | 118533 | 118551 | 19 |
| 3064 | 118553 | 118581 | 29 |
| 3065 | 118587 | 118617 | 31 |
| 3066 | 118620 | 118679 | 60 |
| 3067 | 118687 | 118716 | 30 |
| 3068 | 118731 | 118771 | 41 |
| 3069 | 118779 | 118805 | 27 |
| 3070 | 118816 | 118830 | 15 |
| 3071 | 118832 | 118895 | 64 |
| 3072 | 118910 | 119065 | 156 |
| 3073 | 119067 | 119081 | 15 |
| 3074 | 119095 | 119140 | 46 |
| 3075 | 119170 | 119205 | 36 |
| 3076 | 119210 | 119232 | 23 |
| 3077 | 119230 | 119246 | 17 |
| 3078 | 119236 | 119252 | 17 |
| 3079 | 119255 | 119274 | 20 |
| 3080 | 119271 | 119284 | 14 |
| 3081 | 119290 | 119307 | 18 |
| 3082 | 119320 | 119335 | 16 |
| 3083 | 119357 | 119463 | 107 |
| 3084 | 119465 | 119483 | 19 |
| 3085 | 119485 | 119535 | 51 |
| 3086 | 119550 | 119571 | 22 |
| 3087 | 119577 | 119608 | 32 |
| 3088 | 119610 | 119646 | 37 |
| 3089 | 119648 | 119688 | 41 |
| 3090 | 119713 | 119752 | 40 |
| 3091 | 119743 | 119784 | 42 |
| 3092 | 119786 | 119800 | 15 |
| 3093 | 119822 | 119836 | 15 |
| 3094 | 119830 | 119847 | 18 |
| 3095 | 119849 | 119900 | 52 |
| 3096 | 119912 | 119925 | 14 |
| 3097 | 119960 | 119982 | 23 |
| 3098 | 119984 | 120013 | 30 |
| 3099 | 120038 | 120054 | 17 |
| 3100 | 120057 | 120090 | 34 |
| 3101 | 120092 | 120134 | 43 |
| 3102 | 120138 | 120154 | 17 |
| 3103 | 120157 | 120189 | 33 |
| 3104 | 120187 | 120200 | 14 |
| 3105 | 120191 | 120211 | 21 |
| 3106 | 120225 | 120239 | 15 |
| 3107 | 120242 | 120267 | 26 |
| 3108 | 120271 | 120301 | 31 |
| 3109 | 120320 | 120340 | 21 |
| 3110 | 120363 | 120406 | 44 |
| 3111 | 120406 | 120421 | 16 |
| 3112 | 120414 | 120468 | 55 |
| 3113 | 120457 | 120470 | 14 |
| 3114 | 120487 | 120518 | 32 |
| 3115 | 120545 | 120563 | 19 |
| 3116 | 120567 | 120587 | 21 |
| 3117 | 120589 | 120625 | 37 |
| 3118 | 120619 | 120633 | 15 |
| 3119 | 120650 | 120663 | 14 |
| 3120 | 120676 | 120694 | 19 |
| 3121 | 120703 | 120717 | 15 |
| 3122 | 120721 | 120737 | 17 |
| 3123 | 120755 | 120812 | 58 |
| 3124 | 120816 | 120838 | 23 |
| 3125 | 120843 | 120871 | 29 |
| 3126 | 120873 | 120899 | 27 |
| 3127 | 120903 | 120922 | 20 |
| 3128 | 120933 | 120946 | 14 |
| 3129 | 120936 | 120981 | 46 |
| 3130 | 120983 | 121004 | 22 |
| 3131 | 121006 | 121021 | 16 |
| 3132 | 121023 | 121036 | 14 |
| 3133 | 121035 | 121061 | 27 |
| 3134 | 121063 | 121079 | 17 |
| 3135 | 121081 | 121097 | 17 |
| 3136 | 121105 | 121134 | 30 |
| 3137 | 121138 | 121156 | 19 |
| 3138 | 121155 | 121168 | 14 |
| 3139 | 121158 | 121174 | 17 |
| 3140 | 121166 | 121189 | 24 |
| 3141 | 121194 | 121208 | 15 |
| 3142 | 121201 | 121218 | 18 |
| 3143 | 121213 | 121237 | 25 |
| 3144 | 121246 | 121271 | 26 |
| 3145 | 121298 | 121314 | 17 |
| 3146 | 121311 | 121324 | 14 |
| 3147 | 121327 | 121351 | 25 |
| 3148 | 121359 | 121388 | 30 |
| 3149 | 121390 | 121419 | 30 |
| 3150 | 121446 | 121462 | 17 |
| 3151 | 121468 | 121487 | 20 |
| 3152 | 121499 | 121515 | 17 |
| 3153 | 121517 | 121543 | 27 |
| 3154 | 121545 | 121564 | 20 |
| 3155 | 121575 | 121597 | 23 |
| 3156 | 121599 | 121617 | 19 |
| 3157 | 121619 | 121662 | 44 |
| 3158 | 121664 | 121681 | 18 |
| 3159 | 121683 | 121700 | 18 |
| 3160 | 121702 | 121751 | 50 |
| 3161 | 121773 | 121788 | 16 |
| 3162 | 121790 | 121805 | 16 |
| 3163 | 121807 | 121834 | 28 |
| 3164 | 121836 | 121857 | 22 |
| 3165 | 121859 | 121874 | 16 |
| 3166 | 121877 | 121925 | 49 |
| 3167 | 121923 | 121936 | 14 |
| 3168 | 121928 | 121943 | 16 |
| 3169 | 121962 | 121976 | 15 |
| 3170 | 121978 | 121992 | 15 |
| 3171 | 122004 | 122028 | 25 |
| 3172 | 122030 | 122056 | 27 |
| 3173 | 122046 | 122059 | 14 |
| 3174 | 122052 | 122072 | 21 |
| 3175 | 122080 | 122095 | 16 |
| 3176 | 122099 | 122122 | 24 |
| 3177 | 122143 | 122163 | 21 |
| 3178 | 122169 | 122189 | 21 |
| 3179 | 122258 | 122274 | 17 |
| 3180 | 122289 | 122309 | 21 |
| 3181 | 122311 | 122346 | 36 |
| 3182 | 122357 | 122395 | 39 |
| 3183 | 122446 | 122468 | 23 |
| 3184 | 122471 | 122489 | 19 |
| 3185 | 122491 | 122512 | 22 |
| 3186 | 122526 | 122541 | 16 |
| 3187 | 122543 | 122557 | 15 |
| 3188 | 122579 | 122592 | 14 |
| 3189 | 122606 | 122653 | 48 |
| 3190 | 122663 | 122690 | 28 |
| 3191 | 122728 | 122742 | 15 |
| 3192 | 122757 | 122770 | 14 |
| 3193 | 122779 | 122840 | 62 |
| 3194 | 122842 | 122857 | 16 |
| 3195 | 122900 | 122923 | 24 |
| 3196 | 122933 | 122955 | 23 |
| 3197 | 122968 | 123042 | 75 |
| 3198 | 123055 | 123076 | 22 |
| 3199 | 123094 | 123108 | 15 |
| 3200 | 123114 | 123134 | 21 |
| 3201 | 123143 | 123160 | 18 |
| 3202 | 123162 | 123180 | 19 |

TABLE 1-continued

Regions of SEQ ID NO 1 which may be targeted using oligonucleotide of the invention

| Reg. A | Position in SEQ ID NO 1 from | to | Length |
|---|---|---|---|
| 3203 | 123184 | 123198 | 15 |
| 3204 | 123200 | 123235 | 36 |
| 3205 | 123237 | 123321 | 85 |
| 3206 | 123314 | 123329 | 16 |
| 3207 | 123342 | 123360 | 19 |
| 3208 | 123356 | 123389 | 34 |
| 3209 | 123391 | 123410 | 20 |
| 3210 | 123412 | 123453 | 42 |
| 3211 | 123455 | 123485 | 31 |
| 3212 | 123488 | 123503 | 16 |
| 3213 | 123506 | 123524 | 19 |
| 3214 | 123526 | 123543 | 18 |
| 3215 | 123545 | 123578 | 34 |
| 3216 | 123598 | 123634 | 37 |
| 3217 | 123654 | 123683 | 30 |
| 3218 | 123685 | 123706 | 22 |
| 3219 | 123710 | 123774 | 65 |
| 3220 | 123803 | 123816 | 14 |
| 3221 | 123818 | 123831 | 14 |
| 3222 | 123896 | 123939 | 44 |
| 3223 | 123941 | 123974 | 34 |
| 3224 | 123976 | 124021 | 46 |
| 3225 | 124026 | 124040 | 15 |
| 3226 | 124042 | 124079 | 38 |
| 3227 | 124091 | 124109 | 19 |
| 3228 | 124158 | 124185 | 28 |
| 3229 | 124238 | 124274 | 37 |
| 3230 | 124319 | 124332 | 14 |
| 3231 | 124335 | 124373 | 39 |
| 3232 | 124394 | 124412 | 19 |
| 3233 | 124419 | 124445 | 27 |
| 3234 | 124450 | 124470 | 21 |
| 3235 | 124472 | 124493 | 22 |
| 3236 | 124499 | 124520 | 22 |
| 3237 | 124522 | 124561 | 40 |
| 3238 | 124564 | 124595 | 32 |
| 3239 | 124607 | 124649 | 43 |
| 3240 | 124662 | 124729 | 68 |
| 3241 | 124750 | 124767 | 18 |
| 3242 | 124769 | 124793 | 25 |
| 3243 | 124812 | 124828 | 17 |
| 3244 | 124853 | 124906 | 54 |
| 3245 | 124923 | 124948 | 26 |
| 3246 | 124958 | 124986 | 29 |
| 3247 | 125023 | 125042 | 20 |
| 3248 | 125032 | 125046 | 15 |
| 3249 | 125065 | 125083 | 19 |
| 3250 | 125073 | 125091 | 19 |
| 3251 | 125093 | 125107 | 15 |
| 3252 | 125132 | 125149 | 18 |
| 3253 | 125139 | 125154 | 16 |
| 3254 | 125151 | 125200 | 50 |
| 3255 | 125201 | 125274 | 74 |
| 3256 | 125314 | 125329 | 16 |
| 3257 | 125331 | 125370 | 40 |
| 3258 | 125372 | 125386 | 15 |
| 3259 | 125411 | 125431 | 21 |
| 3260 | 125433 | 125462 | 30 |
| 3261 | 125475 | 125562 | 88 |
| 3262 | 125564 | 125589 | 26 |
| 3263 | 125605 | 125639 | 35 |
| 3264 | 125641 | 125699 | 59 |
| 3265 | 125719 | 125732 | 14 |
| 3266 | 125737 | 125769 | 33 |
| 3267 | 125815 | 125829 | 15 |
| 3268 | 125834 | 125848 | 15 |
| 3269 | 125850 | 125884 | 35 |
| 3270 | 125899 | 125966 | 68 |
| 3271 | 125967 | 125999 | 33 |
| 3272 | 126026 | 126080 | 55 |
| 3273 | 126097 | 126115 | 19 |
| 3274 | 126130 | 126149 | 20 |
| 3275 | 126151 | 126179 | 29 |
| 3276 | 126186 | 126238 | 53 |
| 3277 | 126241 | 126279 | 39 |
| 3278 | 126275 | 126295 | 21 |
| 3279 | 126297 | 126312 | 16 |
| 3280 | 126320 | 126363 | 44 |
| 3281 | 126376 | 126395 | 20 |
| 3282 | 126406 | 126419 | 14 |
| 3283 | 126420 | 126442 | 23 |
| 3284 | 126467 | 126501 | 35 |
| 3285 | 126503 | 126538 | 36 |
| 3286 | 126566 | 126580 | 15 |
| 3287 | 126584 | 126597 | 14 |
| 3288 | 126620 | 126653 | 34 |
| 3289 | 126654 | 126694 | 41 |
| 3290 | 126697 | 126715 | 19 |
| 3291 | 126764 | 126777 | 14 |
| 3292 | 126792 | 126828 | 37 |
| 3293 | 126842 | 126862 | 21 |
| 3294 | 126866 | 126879 | 14 |
| 3295 | 126881 | 126897 | 17 |
| 3296 | 126906 | 126925 | 20 |
| 3297 | 126956 | 126987 | 32 |
| 3298 | 126989 | 127023 | 35 |
| 3299 | 127026 | 127135 | 110 |
| 3300 | 127142 | 127174 | 33 |
| 3301 | 127176 | 127191 | 16 |
| 3302 | 127193 | 127217 | 25 |
| 3303 | 127229 | 127253 | 25 |
| 3304 | 127255 | 127280 | 26 |
| 3305 | 127294 | 127394 | 101 |
| 3306 | 127396 | 127415 | 20 |
| 3307 | 127417 | 127478 | 62 |
| 3308 | 127491 | 127504 | 14 |
| 3309 | 127506 | 127530 | 25 |
| 3310 | 127542 | 127566 | 25 |
| 3311 | 127582 | 127628 | 47 |
| 3312 | 127654 | 127675 | 22 |
| 3313 | 127681 | 127706 | 26 |
| 3314 | 127706 | 127739 | 34 |
| 3315 | 127769 | 127792 | 24 |
| 3316 | 127808 | 127829 | 22 |
| 3317 | 127839 | 127888 | 50 |
| 3318 | 127900 | 127932 | 33 |
| 3319 | 127943 | 127975 | 33 |
| 3320 | 127988 | 128046 | 59 |
| 3321 | 128048 | 128069 | 22 |
| 3322 | 128068 | 128106 | 39 |
| 3323 | 128105 | 128118 | 14 |
| 3324 | 128121 | 128157 | 37 |
| 3325 | 128159 | 128188 | 30 |
| 3326 | 128190 | 128268 | 79 |
| 3327 | 128279 | 128317 | 39 |
| 3328 | 128321 | 128335 | 15 |
| 3329 | 128342 | 128368 | 27 |
| 3330 | 128374 | 128446 | 73 |
| 3331 | 128444 | 128540 | 97 |
| 3332 | 128546 | 128586 | 41 |
| 3333 | 128588 | 128640 | 53 |
| 3334 | 128642 | 128674 | 33 |
| 3335 | 128675 | 128879 | 205 |
| 3336 | 128881 | 128936 | 56 |
| 3337 | 128934 | 129000 | 67 |
| 3338 | 129002 | 129060 | 59 |
| 3339 | 129074 | 129100 | 27 |
| 3340 | 129107 | 129123 | 17 |
| 3341 | 129125 | 129163 | 39 |
| 3342 | 129168 | 129230 | 63 |
| 3343 | 129264 | 129277 | 14 |
| 3344 | 129284 | 129318 | 35 |
| 3345 | 129320 | 129346 | 27 |
| 3346 | 129357 | 129391 | 35 |

TABLE 1-continued

Regions of SEQ ID NO 1 which may be targeted using oligonucleotide of the invention

| Reg. A | Position in SEQ ID NO 1 from | to | Length |
|---|---|---|---|
| 3347 | 129393 | 129420 | 28 |
| 3348 | 129447 | 129485 | 39 |
| 3349 | 129489 | 129504 | 16 |
| 3350 | 129514 | 129540 | 27 |
| 3351 | 129550 | 129563 | 14 |
| 3352 | 129559 | 129595 | 37 |
| 3353 | 129606 | 129627 | 22 |
| 3354 | 129633 | 129681 | 49 |
| 3355 | 129683 | 129697 | 15 |
| 3356 | 129699 | 129716 | 18 |
| 3357 | 129706 | 129738 | 33 |
| 3358 | 129757 | 129790 | 34 |
| 3359 | 129792 | 129820 | 29 |
| 3360 | 129812 | 129846 | 35 |
| 3361 | 129851 | 129867 | 17 |
| 3362 | 129869 | 129883 | 15 |
| 3363 | 129885 | 129915 | 31 |
| 3364 | 129917 | 129955 | 39 |
| 3365 | 129957 | 130046 | 90 |
| 3366 | 130042 | 130070 | 29 |
| 3367 | 130110 | 130156 | 47 |
| 3368 | 130158 | 130309 | 152 |
| 3369 | 130311 | 130373 | 63 |
| 3370 | 130375 | 130391 | 17 |
| 3371 | 130407 | 130429 | 23 |
| 3372 | 130439 | 130461 | 23 |
| 3373 | 130475 | 130507 | 33 |
| 3374 | 130512 | 130550 | 39 |
| 3375 | 130552 | 130582 | 31 |
| 3376 | 130584 | 130614 | 31 |
| 3377 | 130616 | 130764 | 149 |
| 3378 | 130766 | 130869 | 104 |
| 3379 | 130871 | 131021 | 151 |
| 3380 | 131033 | 131051 | 19 |
| 3381 | 131092 | 131105 | 14 |
| 3382 | 131112 | 131188 | 77 |
| 3383 | 131194 | 131237 | 44 |
| 3384 | 131233 | 131247 | 15 |
| 3385 | 131236 | 131287 | 52 |
| 3386 | 131292 | 131307 | 16 |
| 3387 | 131314 | 131333 | 20 |
| 3388 | 131373 | 131386 | 14 |
| 3389 | 131396 | 131417 | 22 |
| 3390 | 131419 | 131439 | 21 |
| 3391 | 131429 | 131458 | 30 |
| 3392 | 131481 | 131499 | 19 |
| 3393 | 131676 | 131689 | 14 |
| 3394 | 131729 | 131743 | 15 |
| 3395 | 131745 | 131764 | 20 |
| 3396 | 131785 | 131807 | 23 |
| 3397 | 131809 | 131875 | 67 |
| 3398 | 131877 | 131953 | 77 |
| 3399 | 131955 | 131980 | 26 |
| 3400 | 132020 | 132068 | 49 |
| 3401 | 132086 | 132108 | 23 |
| 3402 | 132118 | 132138 | 21 |
| 3403 | 132152 | 132183 | 32 |
| 3404 | 132185 | 132205 | 21 |
| 3405 | 132219 | 132232 | 14 |
| 3406 | 132234 | 132252 | 19 |
| 3407 | 132261 | 132291 | 31 |
| 3408 | 132319 | 132337 | 19 |
| 3409 | 132345 | 132363 | 19 |
| 3410 | 132365 | 132378 | 14 |
| 3411 | 132414 | 132483 | 70 |
| 3412 | 132504 | 132547 | 44 |
| 3413 | 132549 | 132582 | 34 |
| 3414 | 132584 | 132602 | 19 |
| 3415 | 132616 | 132642 | 27 |
| 3416 | 132643 | 132681 | 39 |
| 3417 | 132685 | 132714 | 30 |
| 3418 | 132736 | 132769 | 34 |
| 3419 | 132771 | 132793 | 23 |
| 3420 | 132809 | 132825 | 17 |
| 3421 | 132827 | 132841 | 15 |
| 3422 | 132861 | 132884 | 24 |
| 3423 | 132882 | 132900 | 19 |
| 3424 | 132899 | 132915 | 17 |
| 3425 | 132917 | 132951 | 35 |
| 3426 | 132940 | 132954 | 15 |
| 3427 | 132958 | 132983 | 26 |
| 3428 | 132985 | 133031 | 47 |
| 3429 | 133032 | 133051 | 20 |
| 3430 | 133042 | 133060 | 19 |
| 3431 | 133051 | 133071 | 21 |
| 3432 | 133073 | 133087 | 15 |
| 3433 | 133083 | 133104 | 22 |
| 3434 | 133097 | 133110 | 14 |
| 3435 | 133131 | 133199 | 69 |
| 3436 | 133198 | 133222 | 25 |
| 3437 | 133233 | 133249 | 17 |
| 3438 | 133251 | 133284 | 34 |
| 3439 | 133327 | 133429 | 103 |
| 3440 | 133431 | 133596 | 166 |
| 3441 | 133588 | 133602 | 15 |
| 3442 | 133598 | 133611 | 14 |
| 3443 | 133613 | 133628 | 16 |
| 3444 | 133628 | 133646 | 19 |
| 3445 | 133651 | 133670 | 20 |
| 3446 | 133666 | 133707 | 42 |
| 3447 | 133718 | 133742 | 25 |
| 3448 | 133743 | 133777 | 35 |
| 3449 | 133779 | 133794 | 16 |
| 3450 | 133821 | 133851 | 31 |
| 3451 | 133859 | 133880 | 22 |
| 3452 | 133890 | 133921 | 32 |
| 3453 | 133923 | 133974 | 52 |
| 3454 | 133982 | 133998 | 17 |
| 3455 | 134000 | 134036 | 37 |
| 3456 | 134065 | 134107 | 43 |
| 3457 | 134120 | 134173 | 54 |
| 3458 | 134165 | 134179 | 15 |
| 3459 | 134187 | 134200 | 14 |
| 3460 | 134207 | 134242 | 36 |
| 3461 | 134244 | 134258 | 15 |
| 3462 | 134260 | 134273 | 14 |
| 3463 | 134275 | 134299 | 25 |
| 3464 | 134314 | 134346 | 33 |
| 3465 | 134356 | 134371 | 16 |
| 3466 | 134365 | 134380 | 16 |
| 3467 | 134374 | 134420 | 47 |
| 3468 | 134445 | 134477 | 33 |
| 3469 | 134508 | 134523 | 16 |
| 3470 | 134531 | 134548 | 18 |
| 3471 | 134542 | 134555 | 14 |
| 3472 | 134568 | 134621 | 54 |
| 3473 | 134647 | 134667 | 21 |
| 3474 | 134679 | 134719 | 41 |
| 3475 | 134721 | 134824 | 104 |
| 3476 | 134826 | 134849 | 24 |
| 3477 | 134856 | 134869 | 14 |
| 3478 | 134877 | 134910 | 34 |
| 3479 | 134912 | 134966 | 55 |
| 3480 | 134960 | 134980 | 21 |
| 3481 | 134989 | 135012 | 24 |
| 3482 | 135014 | 135066 | 53 |
| 3483 | 135074 | 135093 | 20 |
| 3484 | 135108 | 135125 | 18 |
| 3485 | 135151 | 135260 | 110 |
| 3486 | 135264 | 135277 | 14 |
| 3487 | 135273 | 135310 | 38 |
| 3488 | 135321 | 135337 | 17 |
| 3489 | 135340 | 135365 | 26 |
| 3490 | 135360 | 135374 | 15 |

TABLE 1-continued

Regions of SEQ ID NO 1 which may be targeted using oligonucleotide of the invention

| Reg. A | Position in SEQ ID NO 1 from | to | Length |
|---|---|---|---|
| 3491 | 135364 | 135386 | 23 |
| 3492 | 135388 | 135430 | 43 |
| 3493 | 135432 | 135447 | 16 |
| 3494 | 135498 | 135521 | 24 |
| 3495 | 135519 | 135545 | 27 |
| 3496 | 135559 | 135622 | 64 |
| 3497 | 135624 | 135647 | 24 |
| 3498 | 135656 | 135673 | 18 |
| 3499 | 135675 | 135704 | 30 |
| 3500 | 135721 | 135742 | 22 |
| 3501 | 135753 | 135796 | 44 |
| 3502 | 135815 | 135858 | 44 |
| 3503 | 135860 | 135880 | 21 |
| 3504 | 135883 | 135915 | 33 |
| 3505 | 135922 | 135965 | 44 |
| 3506 | 135979 | 135993 | 15 |
| 3507 | 135995 | 136036 | 42 |
| 3508 | 136051 | 136065 | 15 |
| 3509 | 136108 | 136165 | 58 |
| 3510 | 136173 | 136190 | 18 |
| 3511 | 136192 | 136287 | 96 |
| 3512 | 136289 | 136303 | 15 |
| 3513 | 136317 | 136346 | 30 |
| 3514 | 136375 | 136415 | 41 |
| 3515 | 136429 | 136470 | 42 |
| 3516 | 136472 | 136496 | 25 |
| 3517 | 136498 | 136532 | 35 |
| 3518 | 136542 | 136565 | 24 |
| 3519 | 136643 | 136657 | 15 |
| 3520 | 136674 | 136701 | 28 |
| 3521 | 136704 | 136719 | 16 |
| 3522 | 136715 | 136728 | 14 |
| 3523 | 136721 | 136737 | 17 |
| 3524 | 136737 | 136750 | 14 |
| 3525 | 136783 | 136810 | 28 |
| 3526 | 136824 | 136849 | 26 |
| 3527 | 136859 | 136896 | 38 |
| 3528 | 136898 | 136927 | 30 |
| 3529 | 136949 | 136983 | 35 |
| 3530 | 136985 | 137000 | 16 |
| 3531 | 137053 | 137071 | 19 |
| 3532 | 137077 | 137097 | 21 |
| 3533 | 137108 | 137164 | 57 |
| 3534 | 137166 | 137196 | 31 |
| 3535 | 137198 | 137221 | 24 |
| 3536 | 137223 | 137267 | 45 |
| 3537 | 137276 | 137359 | 84 |
| 3538 | 137360 | 137385 | 26 |
| 3539 | 137393 | 137440 | 48 |
| 3540 | 137438 | 137496 | 59 |
| 3541 | 137498 | 137518 | 21 |
| 3542 | 137523 | 137536 | 14 |
| 3543 | 137539 | 137572 | 34 |
| 3544 | 137584 | 137612 | 29 |
| 3545 | 137614 | 137628 | 15 |
| 3546 | 137630 | 137644 | 15 |
| 3547 | 137646 | 137669 | 24 |
| 3548 | 137702 | 137727 | 26 |
| 3549 | 137731 | 137745 | 15 |
| 3550 | 137759 | 137772 | 14 |
| 3551 | 137784 | 137819 | 36 |
| 3552 | 137832 | 137858 | 27 |
| 3553 | 137861 | 137876 | 16 |
| 3554 | 137878 | 137900 | 23 |
| 3555 | 137909 | 137925 | 17 |
| 3556 | 137924 | 137961 | 38 |
| 3557 | 137968 | 137981 | 14 |
| 3558 | 138011 | 138033 | 23 |
| 3559 | 138035 | 138077 | 43 |
| 3560 | 138079 | 138097 | 19 |
| 3561 | 138224 | 138238 | 15 |
| 3562 | 138232 | 138252 | 21 |
| 3563 | 138242 | 138256 | 15 |
| 3564 | 138255 | 138284 | 30 |
| 3565 | 138295 | 138326 | 32 |
| 3566 | 138328 | 138357 | 30 |
| 3567 | 138359 | 138389 | 31 |
| 3568 | 138403 | 138449 | 47 |
| 3569 | 138451 | 138492 | 42 |
| 3570 | 138500 | 138515 | 16 |
| 3571 | 138524 | 138548 | 25 |
| 3572 | 138555 | 138568 | 14 |
| 3573 | 138571 | 138589 | 19 |
| 3574 | 138589 | 138629 | 41 |
| 3575 | 138644 | 138680 | 37 |
| 3576 | 138697 | 138710 | 14 |
| 3577 | 138712 | 138729 | 18 |
| 3578 | 138744 | 138761 | 18 |
| 3579 | 138776 | 138801 | 26 |
| 3580 | 138860 | 138896 | 37 |
| 3581 | 138898 | 138923 | 26 |
| 3582 | 138925 | 138965 | 41 |
| 3583 | 138967 | 139008 | 42 |
| 3584 | 139010 | 139031 | 22 |
| 3585 | 139029 | 139043 | 15 |
| 3586 | 139034 | 139048 | 15 |
| 3587 | 139041 | 139056 | 16 |
| 3588 | 139055 | 139074 | 20 |
| 3589 | 139078 | 139094 | 17 |
| 3590 | 139084 | 139098 | 15 |
| 3591 | 139092 | 139116 | 25 |
| 3592 | 139133 | 139147 | 15 |
| 3593 | 139154 | 139173 | 20 |
| 3594 | 139175 | 139192 | 18 |
| 3595 | 139204 | 139229 | 26 |
| 3596 | 139231 | 139255 | 25 |
| 3597 | 139257 | 139270 | 14 |
| 3598 | 139272 | 139303 | 32 |
| 3599 | 139315 | 139335 | 21 |
| 3600 | 139337 | 139372 | 36 |
| 3601 | 139383 | 139397 | 15 |
| 3602 | 139399 | 139419 | 21 |
| 3603 | 139423 | 139437 | 15 |
| 3604 | 139435 | 139492 | 58 |
| 3605 | 139501 | 139518 | 18 |
| 3606 | 139508 | 139521 | 14 |
| 3607 | 139571 | 139586 | 16 |
| 3608 | 139588 | 139622 | 35 |
| 3609 | 139636 | 139655 | 20 |
| 3610 | 139657 | 139673 | 17 |
| 3611 | 139685 | 139699 | 15 |
| 3612 | 139724 | 139795 | 72 |
| 3613 | 139796 | 139811 | 16 |
| 3614 | 139818 | 139834 | 17 |
| 3615 | 139836 | 139857 | 22 |
| 3616 | 139856 | 139869 | 14 |
| 3617 | 139859 | 139882 | 24 |
| 3618 | 139891 | 139920 | 30 |
| 3619 | 139930 | 139952 | 23 |
| 3620 | 139965 | 139980 | 16 |
| 3621 | 139982 | 140011 | 30 |
| 3622 | 140013 | 140031 | 19 |
| 3623 | 140047 | 140072 | 26 |
| 3624 | 140074 | 140099 | 26 |
| 3625 | 140101 | 140119 | 19 |
| 3626 | 140121 | 140135 | 15 |
| 3627 | 140144 | 140158 | 15 |
| 3628 | 140157 | 140183 | 27 |
| 3629 | 140185 | 140210 | 26 |
| 3630 | 140231 | 140262 | 32 |
| 3631 | 140258 | 140272 | 15 |
| 3632 | 140264 | 140288 | 25 |
| 3633 | 140290 | 140325 | 36 |
| 3634 | 140339 | 140364 | 26 |

TABLE 1-continued

Regions of SEQ ID NO 1 which may be targeted using oligonucleotide of the invention

| Reg. A | Position in SEQ ID NO 1 from | to | Length |
|---|---|---|---|
| 3635 | 140369 | 140402 | 34 |
| 3636 | 140428 | 140451 | 24 |
| 3637 | 140453 | 140510 | 58 |
| 3638 | 140512 | 140541 | 30 |
| 3639 | 140556 | 140621 | 66 |
| 3640 | 140626 | 140651 | 26 |
| 3641 | 140653 | 140724 | 72 |
| 3642 | 140726 | 140789 | 64 |
| 3643 | 140802 | 140825 | 24 |
| 3644 | 140837 | 140861 | 25 |
| 3645 | 140863 | 140896 | 34 |
| 3646 | 140903 | 140927 | 25 |
| 3647 | 140958 | 140993 | 36 |
| 3648 | 141001 | 141014 | 14 |
| 3649 | 141022 | 141053 | 32 |

In some embodiments, the oligonucleotide comprises a contiguous nucleotide sequence of 10 to 30 nucleotides in length with at least 90% complementary, such as 100% complementarity, to a corresponding target nucleic acid region present in SEQ ID NO: 1, wherein the target nucleic acid region is selected from the group consisting of region B1 to B400 in table 2

TABLE 2

Regions of SEQ ID NO 1 which may be targeted using oligonucleotide of the invention

| Reg. | Position in SEQ ID NO 1 To | From | Length |
|---|---|---|---|
| B1 | 225 | 238 | 14 |
| B2 | 1163 | 1178 | 16 |
| B3 | 2526 | 2539 | 14 |
| B4 | 2805 | 2820 | 16 |
| B5 | 3027 | 3040 | 14 |
| B6 | 3208 | 3222 | 15 |
| B7 | 3212 | 3225 | 14 |
| B8 | 3228 | 3241 | 14 |
| B9 | 3243 | 3256 | 14 |
| B10 | 3810 | 3854 | 45 |
| B11 | 4664 | 4680 | 17 |
| B12 | 5516 | 5529 | 14 |
| B13 | 5657 | 5671 | 15 |
| B14 | 5661 | 5676 | 16 |
| B15 | 5964 | 5977 | 14 |
| B16 | 6217 | 6234 | 18 |
| B17 | 6224 | 6237 | 14 |
| B18 | 6408 | 6422 | 15 |
| B19 | 7300 | 7313 | 14 |
| B20 | 7399 | 7412 | 14 |
| B21 | 7541 | 7564 | 24 |
| B22 | 7626 | 7640 | 15 |
| B23 | 7662 | 7694 | 33 |
| B24 | 7791 | 7806 | 16 |
| B25 | 7853 | 7868 | 16 |
| B26 | 8206 | 8219 | 14 |
| B27 | 8443 | 8456 | 14 |
| B28 | 8739 | 8752 | 14 |
| B29 | 9197 | 9212 | 16 |
| B30 | 10189 | 10203 | 15 |
| B31 | 10754 | 10768 | 15 |
| B32 | 10758 | 10771 | 14 |
| B33 | 11790 | 11803 | 14 |
| B34 | 11870 | 11883 | 14 |
| B35 | 11993 | 12007 | 15 |

TABLE 2-continued

Regions of SEQ ID NO 1 which may be targeted using oligonucleotide of the invention

| Reg. | Position in SEQ ID NO 1 To | From | Length |
|---|---|---|---|
| B36 | B11996 | 12011 | 16 |
| B37 | 12017 | 12040 | 24 |
| B38 | 12095 | 12108 | 14 |
| B39 | 12345 | 12358 | 14 |
| B40 | 12721 | 12734 | 14 |
| B41 | 13372 | 13386 | 15 |
| B42 | 13489 | 13505 | 17 |
| B43 | 15576 | 15590 | 15 |
| B44 | 15617 | 15632 | 16 |
| B45 | 15840 | 15853 | 14 |
| B46 | 16041 | 16054 | 14 |
| B47 | 16207 | 16222 | 16 |
| B48 | 16308 | 16321 | 14 |
| B49 | 16349 | 16362 | 14 |
| B50 | 16463 | 16479 | 17 |
| B51 | 16528 | 16542 | 15 |
| B52 | 16543 | 16556 | 14 |
| B53 | 20495 | 20508 | 14 |
| B54 | 20617 | 20630 | 14 |
| B55 | 20960 | 20977 | 18 |
| B56 | 21465 | 21479 | 15 |
| B57 | 21491 | 21508 | 18 |
| B58 | 23479 | 23496 | 18 |
| B59 | 23741 | 23755 | 15 |
| B60 | 25236 | 25249 | 14 |
| B61 | 25323 | 25336 | 14 |
| B62 | 25447 | 25462 | 16 |
| B63 | 25588 | 25601 | 14 |
| B64 | 25853 | 25867 | 15 |
| B65 | 25885 | 25898 | 14 |
| B66 | 26280 | 26293 | 14 |
| B67 | 26388 | 26404 | 17 |
| B68 | 26416 | 26450 | 35 |
| B69 | 26687 | 26702 | 16 |
| B70 | 26706 | 26719 | 14 |
| B71 | 26783 | 26796 | 14 |
| B72 | 27039 | 27052 | 14 |
| B73 | 27251 | 27265 | 15 |
| B74 | 28683 | 28698 | 16 |
| B75 | 29302 | 29315 | 14 |
| B76 | 29304 | 29317 | 14 |
| B77 | 29308 | 29321 | 14 |
| B78 | 29532 | 29545 | 14 |
| B79 | 29974 | 29987 | 14 |
| B80 | 30054 | 30068 | 15 |
| B81 | 30267 | 30281 | 15 |
| B82 | 30623 | 30638 | 16 |
| B83 | 30628 | 30641 | 14 |
| B84 | 30814 | 30827 | 14 |
| B85 | 30881 | 30894 | 14 |
| B86 | 32459 | 32478 | 20 |
| B87 | 37299 | 37315 | 17 |
| B88 | 39083 | 39096 | 14 |
| B89 | 39370 | 39383 | 14 |
| B90 | 39659 | 39672 | 14 |
| B91 | 40814 | 40831 | 18 |
| B92 | 40851 | 40864 | 14 |
| B93 | 41782 | 41795 | 14 |
| B94 | 41873 | 41886 | 14 |
| B95 | 42037 | 42050 | 14 |
| B96 | 42048 | 42063 | 16 |
| B97 | 42096 | 42116 | 21 |
| B98 | 42959 | 42973 | 15 |
| B99 | 43165 | 43178 | 14 |
| B100 | 45926 | 45939 | 14 |
| B101 | 48163 | 48176 | 14 |
| B102 | 52732 | 52745 | 14 |
| B103 | 52984 | 53015 | 32 |
| B104 | 54404 | 54420 | 17 |
| B105 | 55294 | 55320 | 27 |
| B106 | 55337 | 55350 | 14 |
| B107 | 55420 | 55434 | 15 |

TABLE 2-continued

Regions of SEQ ID NO 1 which may be targeted using oligonucleotide of the invention

| Reg. | Position in SEQ ID NO 1 To | From | Length |
|---|---|---|---|
| B108 | 55487 | 55501 | 15 |
| B109 | 55623 | 55638 | 16 |
| B110 | 56195 | 56214 | 20 |
| B111 | 56584 | 56597 | 14 |
| B112 | 57267 | 57282 | 16 |
| B113 | 58126 | 58139 | 14 |
| B114 | 58170 | 58183 | 14 |
| B115 | 58295 | 58309 | 15 |
| B116 | 58658 | 58671 | 14 |
| B117 | 58906 | 58921 | 16 |
| B118 | 58988 | 59005 | 18 |
| B119 | 59024 | 59045 | 22 |
| B120 | 59191 | 59207 | 17 |
| B121 | 59236 | 59251 | 16 |
| B122 | 59298 | 59312 | 15 |
| B123 | 59358 | 59378 | 21 |
| B124 | 59400 | 59413 | 14 |
| B125 | 59434 | 59447 | 14 |
| B126 | 59589 | 59602 | 14 |
| B127 | 59620 | 59642 | 23 |
| B128 | 59718 | 59743 | 26 |
| B129 | 59826 | 59841 | 16 |
| B130 | 59843 | 59864 | 22 |
| B131 | 59882 | 59906 | 25 |
| B132 | 59930 | 59958 | 29 |
| B133 | 59959 | 60004 | 46 |
| B134 | 60006 | 60029 | 24 |
| B135 | 60033 | 60071 | 39 |
| B136 | 60139 | 60171 | 33 |
| B137 | 60193 | 60215 | 23 |
| B138 | 60212 | 60225 | 14 |
| B139 | 60231 | 60244 | 14 |
| B140 | 60246 | 60265 | 20 |
| B141 | 60267 | 60282 | 16 |
| B142 | 60292 | 60309 | 18 |
| B143 | 60348 | 60361 | 14 |
| B144 | 60358 | 60429 | 72 |
| B145 | 60427 | 60517 | 91 |
| B146 | 60519 | 60545 | 27 |
| B147 | 60557 | 60575 | 19 |
| B148 | 60580 | 60593 | 14 |
| B149 | 60595 | 60622 | 28 |
| B150 | 60675 | 60690 | 16 |
| B151 | 60697 | 60713 | 17 |
| B152 | 60727 | 60754 | 28 |
| B153 | 60756 | 60799 | 44 |
| B154 | 60801 | 60817 | 17 |
| B155 | 60819 | 60855 | 37 |
| B156 | 61423 | 61436 | 14 |
| B157 | 61592 | 61605 | 14 |
| B158 | 61624 | 61637 | 14 |
| B159 | 61673 | 61713 | 41 |
| B160 | 61715 | 61731 | 17 |
| B161 | 61733 | 61752 | 20 |
| B162 | 61769 | 61794 | 26 |
| B163 | 61805 | 61825 | 21 |
| B164 | 62101 | 62114 | 14 |
| B165 | 62302 | 62315 | 14 |
| B166 | 62436 | 62449 | 14 |
| B167 | 62664 | 62679 | 16 |
| B168 | 62993 | 63006 | 14 |
| B169 | 63098 | 63111 | 14 |
| B170 | 63347 | 63367 | 21 |
| B171 | 63371 | 63396 | 26 |
| B172 | 63385 | 63398 | 14 |
| B173 | 63526 | 63539 | 14 |
| B174 | 65032 | 65045 | 14 |
| B175 | 66556 | 66569 | 14 |
| B176 | 67158 | 67183 | 26 |
| B177 | 67181 | 67194 | 14 |
| B178 | 68007 | 68021 | 15 |
| B179 | 68644 | 68657 | 14 |
| B180 | 69294 | 69317 | 24 |
| B181 | 69306 | 69323 | 18 |
| B182 | 69353 | 69366 | 14 |
| B183 | 70497 | 70511 | 15 |
| B184 | 71600 | 71613 | 14 |
| B185 | 71887 | 71905 | 19 |
| B186 | 72259 | 72272 | 14 |
| B187 | 72589 | 72602 | 14 |
| B188 | 72783 | 72796 | 14 |
| B189 | 73528 | 73541 | 14 |
| B190 | 73783 | 73800 | 18 |
| B191 | 74907 | 74920 | 14 |
| B192 | 75965 | 75981 | 17 |
| B193 | 75983 | 75998 | 16 |
| B194 | 76004 | 76020 | 17 |
| B195 | 76110 | 76166 | 57 |
| B196 | 76186 | 76205 | 20 |
| B197 | 76234 | 76253 | 20 |
| B198 | 76261 | 76280 | 20 |
| B199 | 76369 | 76382 | 14 |
| B200 | 77139 | 77152 | 14 |
| B201 | 77409 | 77422 | 14 |
| B202 | 77478 | 77524 | 47 |
| B203 | 77526 | 77590 | 65 |
| B204 | 77628 | 77641 | 14 |
| B205 | 77688 | 77701 | 14 |
| B206 | 78275 | 78308 | 34 |
| B207 | 78310 | 78332 | 23 |
| B208 | 78340 | 78356 | 17 |
| B209 | 78358 | 78371 | 14 |
| B210 | 78373 | 78395 | 23 |
| B211 | 78397 | 78440 | 44 |
| B212 | 78442 | 78455 | 14 |
| B213 | 78475 | 78489 | 15 |
| B214 | 78696 | 78709 | 14 |
| B215 | 78847 | 78860 | 14 |
| B216 | 79493 | 79516 | 24 |
| B217 | 79705 | 79718 | 14 |
| B218 | 81009 | 81054 | 46 |
| B219 | 81353 | 81367 | 15 |
| B220 | 81970 | 81986 | 17 |
| B221 | 81991 | 82006 | 16 |
| B222 | 82042 | 82106 | 65 |
| B223 | 82278 | 82291 | 14 |
| B224 | 82716 | 82735 | 20 |
| B225 | 84314 | 84328 | 15 |
| B226 | 85628 | 85665 | 38 |
| B227 | 86226 | 86239 | 14 |
| B228 | 86237 | 86253 | 17 |
| B229 | 86566 | 86579 | 14 |
| B230 | 86945 | 86959 | 15 |
| B231 | 87337 | 87358 | 22 |
| B232 | 87662 | 87675 | 14 |
| B233 | 89424 | 89439 | 16 |
| B234 | 89972 | 89985 | 14 |
| B235 | 90782 | 90795 | 14 |
| B236 | 90939 | 90953 | 15 |
| B237 | 90942 | 90955 | 14 |
| B238 | 90965 | 90981 | 17 |
| B239 | 91101 | 91115 | 15 |
| B240 | 92083 | 92096 | 14 |
| B241 | 92164 | 92177 | 14 |
| B242 | 92179 | 92192 | 14 |
| B243 | 92194 | 92210 | 17 |
| B244 | 92212 | 92236 | 25 |
| B245 | 92245 | 92260 | 16 |
| B246 | 92262 | 92302 | 41 |
| B247 | 92304 | 92321 | 18 |
| B248 | 92323 | 92366 | 44 |
| B249 | 92375 | 92389 | 15 |
| B250 | 92392 | 92405 | 14 |
| B251 | 92407 | 92426 | 20 |

TABLE 2-continued

Regions of SEQ ID NO 1 which may be targeted using oligonucleotide of the invention Position in SEQ ID NO 1

| Reg. | To | From | Length |
|---|---|---|---|
| B252 | 92442 | 92459 | 18 |
| B253 | 92497 | 92516 | 20 |
| B254 | 92578 | 92591 | 14 |
| B255 | 92599 | 92612 | 14 |
| B256 | 92614 | 92651 | 38 |
| B257 | 92659 | 92684 | 26 |
| B258 | 92686 | 92699 | 14 |
| B259 | 92704 | 92726 | 23 |
| B260 | 92731 | 92750 | 20 |
| B261 | 92752 | 92774 | 23 |
| B262 | 92780 | 92795 | 16 |
| B263 | 92800 | 92813 | 14 |
| B264 | 92839 | 92858 | 20 |
| B265 | 92860 | 92891 | 32 |
| B266 | 92893 | 92906 | 14 |
| B267 | 92908 | 92921 | 14 |
| B268 | 92923 | 92941 | 19 |
| B269 | 92965 | 92986 | 22 |
| B270 | 92988 | 93002 | 15 |
| B271 | 93044 | 93059 | 16 |
| B272 | 93061 | 93076 | 16 |
| B273 | 93105 | 93122 | 18 |
| B274 | 93142 | 93209 | 68 |
| B275 | 93227 | 93241 | 15 |
| B276 | 93288 | 93305 | 18 |
| B277 | 93325 | 93344 | 20 |
| B278 | 93398 | 93412 | 15 |
| B279 | 93572 | 93586 | 15 |
| B280 | 94509 | 94522 | 14 |
| B281 | 95720 | 95738 | 19 |
| B282 | 97050 | 97065 | 16 |
| B283 | 97079 | 97098 | 20 |
| B284 | 97127 | 97194 | 68 |
| B285 | 97208 | 97230 | 23 |
| B286 | 97232 | 97284 | 53 |
| B287 | 97286 | 97311 | 26 |
| B288 | 97313 | 97362 | 50 |
| B289 | 97368 | 97383 | 16 |
| B290 | 97426 | 97439 | 14 |
| B291 | 98077 | 98090 | 14 |
| B292 | 98227 | 98240 | 14 |
| B293 | 98232 | 98255 | 24 |
| B294 | 99151 | 99164 | 14 |
| B295 | 99405 | 99418 | 14 |
| B296 | 99570 | 99583 | 14 |
| B297 | 99733 | 99748 | 16 |
| B298 | 101829 | 101842 | 14 |
| B299 | 101882 | 101895 | 14 |
| B300 | 101955 | 101968 | 14 |
| B301 | 102202 | 102215 | 14 |
| B302 | 103310 | 103325 | 16 |
| B303 | 103653 | 103666 | 14 |
| B304 | 103908 | 103923 | 16 |
| B305 | 103912 | 103928 | 17 |
| B306 | 103917 | 103933 | 17 |
| B307 | 104971 | 104984 | 14 |
| B308 | 105217 | 105230 | 14 |
| B309 | 105233 | 105250 | 18 |
| B310 | 105443 | 105457 | 15 |
| B311 | 105544 | 105559 | 16 |
| B312 | 106047 | 106071 | 25 |
| B313 | 106061 | 106074 | 14 |
| B314 | 106093 | 106107 | 15 |
| B315 | 106114 | 106130 | 17 |
| B316 | 106243 | 106256 | 14 |
| B317 | 106251 | 106264 | 14 |
| B318 | 106840 | 106855 | 16 |
| B319 | 108113 | 108130 | 18 |
| B320 | 108325 | 108338 | 14 |
| B321 | 108856 | 108869 | 14 |
| B322 | 109109 | 109122 | 14 |
| B323 | 109113 | 109127 | 15 |
| B324 | 109116 | 109132 | 17 |
| B325 | 110301 | 110314 | 14 |
| B326 | 110315 | 110328 | 14 |
| B327 | 110317 | 110330 | 14 |
| B328 | 112528 | 112546 | 19 |
| B329 | 112607 | 112620 | 14 |
| B330 | 114775 | 114788 | 14 |
| B331 | 116322 | 116335 | 14 |
| B332 | 116968 | 116981 | 14 |
| B333 | 117788 | 117801 | 14 |
| B334 | 118034 | 118057 | 24 |
| B335 | 118230 | 118246 | 17 |
| B336 | 118235 | 118248 | 14 |
| B337 | 118870 | 118883 | 14 |
| B338 | 119755 | 119784 | 30 |
| B339 | 119786 | 119800 | 15 |
| B340 | 120363 | 120406 | 44 |
| B341 | 120504 | 120517 | 14 |
| B342 | 121161 | 121174 | 14 |
| B343 | 121330 | 121347 | 18 |
| B344 | 121338 | 121351 | 14 |
| B345 | 123417 | 123430 | 14 |
| B346 | 123464 | 123481 | 18 |
| B347 | 125026 | 125042 | 17 |
| B348 | 127046 | 127071 | 26 |
| B349 | 127090 | 127103 | 14 |
| B350 | 127311 | 127324 | 14 |
| B351 | 127354 | 127367 | 14 |
| B352 | 127363 | 127379 | 17 |
| B353 | 127399 | 127412 | 14 |
| B354 | 127863 | 127876 | 14 |
| B355 | 128134 | 128148 | 15 |
| B356 | 128280 | 128310 | 31 |
| B357 | 128343 | 128368 | 26 |
| B358 | 128444 | 128457 | 14 |
| B359 | 128446 | 128469 | 24 |
| B360 | 128498 | 128511 | 14 |
| B361 | 128511 | 128524 | 14 |
| B362 | 129892 | 129905 | 14 |
| B363 | 130261 | 130283 | 23 |
| B364 | 130375 | 130388 | 14 |
| B365 | 130415 | 130428 | 14 |
| B366 | 130634 | 130650 | 17 |
| B367 | 130667 | 130717 | 51 |
| B368 | 130719 | 130764 | 46 |
| B369 | 130783 | 130796 | 14 |
| B370 | 130798 | 130820 | 23 |
| B371 | 130840 | 130861 | 22 |
| B372 | 130975 | 130994 | 20 |
| B373 | 131112 | 131132 | 21 |
| B374 | 131142 | 131161 | 20 |
| B375 | 131233 | 131246 | 14 |
| B376 | 131729 | 131743 | 15 |
| B377 | 132754 | 132767 | 14 |
| B378 | 132924 | 132937 | 14 |
| B379 | 133174 | 133190 | 17 |
| B380 | 133198 | 133212 | 15 |
| B381 | 133207 | 133222 | 16 |
| B382 | 133476 | 133489 | 14 |
| B383 | 133479 | 133492 | 14 |
| B384 | 133491 | 133531 | 41 |
| B385 | 133533 | 133550 | 18 |
| B386 | 133555 | 133594 | 40 |
| B387 | 134160 | 134173 | 14 |
| B388 | 134165 | 134178 | 14 |
| B389 | 134533 | 134546 | 14 |
| B390 | 136724 | 136737 | 14 |
| B391 | 137438 | 137463 | 26 |
| B392 | 137878 | 137891 | 14 |
| B393 | 138082 | 138097 | 16 |
| B394 | 138233 | 138252 | 20 |
| B395 | 138930 | 138943 | 14 |

TABLE 2-continued

Regions of SEQ ID NO 1 which may be targeted using oligonucleotide of the invention

| Reg. | Position in SEQ ID NO 1 | | Length |
|---|---|---|---|
| | To | From | |
| B396 | 138947 | 138960 | 14 |
| B397 | 138950 | 138963 | 14 |
| B398 | 139502 | 139518 | 17 |
| B399 | 139508 | 139521 | 14 |
| B400 | 140978 | 140991 | 14 |

In certain embodiments the oligonucleotide or contiguous nucleotide sequence is complementary to a region (or sub-sequence)(or sub-sequence) of the target nucleic acid, wherein the target nucleic acid region is selected from the group consisting of position 1589-10889, 46089-53989 and 60789-62489 of SEQ ID NO: 1.

In one embodiment the oligonucleotide comprises a contiguous nucleotide sequence of 10 to 30 nucleotides in length with at least 90%, such as 100% complementary to a target nucleic acid sequence of position 55319 to 141053 of SEQ ID NO: 1.

In one embodiment the oligonucleotide comprises a contiguous nucleotide sequence of 10 to 30 nucleotides in length with at least 90%, such as 100% complementary to a target nucleic acid sequence of position 1 to 55318 of SEQ ID NO: 1.

In some embodiments, the oligonucleotide comprises a contiguous nucleotide sequence of 10 to 30 nucleotides in length with at least 90% complementary to a sub-sequence of the target nucleic acid selected from the group corresponding to positions: 55319-76274, 77483-77573, 92157-93403 and 97056-97354 of SEQ ID NO: 1.

In some embodiments the oligonucleotide a contiguous nucleotide sequence of 10 to 30 nucleotides in length with at least 90% complementary to a sub-sequence of the target nucleic acid selected from the group corresponding to positions: 60821-60849, 77567-77583, 92323-92339 and 97156-97172 of SEQ ID NO: 1.

In some embodiments the oligonucleotide a contiguous nucleotide sequence of 10 to 30 nucleotides in length with at least 90% complementary to a sub-sequence of the target nucleic acid corresponding to positions: 5218-5240 of SEQ ID NO: 1.

In some embodiments the oligonucleotide a contiguous nucleotide sequence of 10 to 30 nucleotides in length with at least 90% complementary to a sub-sequence of the target nucleic acid corresponding to positions: 5782-5803 of SEQ ID NO: 1.

In some embodiments the oligonucleotide a contiguous nucleotide sequence of 10 to 30 nucleotides in length with at least 90% complementary to a sub-sequence of the target nucleic acid corresponding to positions: 8113-8139 of SEQ ID NO: 1.

In some embodiments the oligonucleotide a contiguous nucleotide sequence of 10 to 30 nucleotides in length with at least 90% complementary to a sub-sequence of the target nucleic acid corresponding to positions: 9200-9250 of SEQ ID NO: 1.

In some embodiments the oligonucleotide a contiguous nucleotide sequence of 10 to 30 nucleotides in length with at least 90% complementary to a sub-sequence of the target nucleic acid corresponding to positions: 11505-11555 of SEQ ID NO: 1.

In some embodiments the oligonucleotide a contiguous nucleotide sequence of 10 to 30 nucleotides in length with at least 90% complementary to a sub-sequence of the target nucleic acid corresponding to positions: 13223-13242 of SEQ ID NO: 1.

In some embodiments the oligonucleotide a contiguous nucleotide sequence of 10 to 30 nucleotides in length with at least 90% complementary to a sub-sequence of the target nucleic acid corresponding to positions 15100-15150 of SEQ ID NO: 1.

In some embodiments the oligonucleotide a contiguous nucleotide sequence of 10 to 30 nucleotides in length with at least 90% complementary to a sub-sequence of the target nucleic acid corresponding to positions 15113-15180 of SEQ ID NO: 1.

In some embodiments the oligonucleotide a contiguous nucleotide sequence of 10 to 30 nucleotides in length with at least 90% complementary to a sub-sequence of the target nucleic acid corresponding to positions 29635-29705 of SEQ ID NO: 1.

In some embodiments the oligonucleotide a contiguous nucleotide sequence of 10 to 30 nucleotides in length with at least 90% complementary to a sub-sequence of the target nucleic acid corresponding to positions 30590-30740 of SEQ ID NO: 1.

In some embodiments the oligonucleotide a contiguous nucleotide sequence of 10 to 30 nucleotides in length with at least 90% complementary to a sub-sequence of the target nucleic acid corresponding to positions 39800-39855 of SEQ ID NO: 1.

In some embodiments the oligonucleotide a contiguous nucleotide sequence of 10 to 30 nucleotides in length with at least 90% complementary to a sub-sequence of the target nucleic acid to positions 44435-44460 of SEQ ID NO: 1.

In some embodiments the oligonucleotide a contiguous nucleotide sequence of 10 to 30 nucleotides in length with at least 90% complementary to a sub-sequence of the target nucleic acid to positions 45245-45270 of SEQ ID NO: 1.

In some embodiments the oligonucleotide a contiguous nucleotide sequence of 10 to 30 nucleotides in length with at least 90% complementary to a sub-sequence of the target nucleic acid to positions 46380-46430 of SEQ ID NO: 1.

In some embodiments the oligonucleotide a contiguous nucleotide sequence of 10 to 30 nucleotides in length with at least 90% complementary to a sub-sequence of the target nucleic acid to positions 68915-68940 of SEQ ID NO: 1.

In some embodiments, the oligonucleotide comprises or consists of 8 to 35 nucleotides in length, such as from 10 to 30, such as 11 to 22, such as from 12 to 18, such as from 13 to 17 or 14 to 16 contiguous nucleotides in length. In a preferred embodiment, the oligonucleotide comprises or consists of 15 to 20 nucleotides in length.

In some embodiments, the oligonucleotide or contiguous nucleotide sequence thereof comprises or consists of 22 or less nucleotides, such as 20 or less nucleotides, such as 18 or less nucleotides, such as 14, 15, 16 or 17 nucleotides. It is to be understood that any range given herein includes the range endpoints. Accordingly, if an oligonucleotide is said to include from 10 to 30 nucleotides, both 10 and 30 nucleotides are included.

In some embodiments, the contiguous nucleotide sequence comprises or consists of 8, 9, 10, 11, 12, 13, 14, 15, 16, 17, 18, 19, 20, 21, 22, 23, 24, 25, 26, 27, 28, 29 or 30 contiguous nucleotides in length. In a preferred embodiment, the oligonucleotide comprises or consists of 16, 17, 18 or 19 nucleotides in length.

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 4 to 150 (see motif sequences listed in table 3 in the Examples section).

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 4 to 818 (see motif sequences listed in table 3 in the Examples section).

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 4 to 678 (see motif sequences listed in table 3 in the Examples section).

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 166, 167, 167 or 169 (see motif sequences listed in table 3 in the Examples section).

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 570, 571, 572, 679, 680, 681, 682 and 683 (see motif sequences listed in table 3 in the Examples section).

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 34, 186, 187, 188, 573, 574, 575, 576, 572, 684, 685, 686, 687, 688, 689, 690, 691, 692, 963, 964, 965 and 696 (see motif sequences listed in table 3 in the Examples section).

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 35, 199, 200, 201, 202, 203, 204, 205, 206, 207, 209 and 210 or SEQ ID NO: 582, 583 and 584 (see motif sequences listed in table 3 in the Examples section).

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 221, 222, 223, 224, 225, 585, 586, 587, 588, 589, 698, 699, 700, 701, 702, 703, 704, 705, 706, 707, 708, 709, 710, 711, 712, 713, 714, 715, 716, 717 and 718 (see motif sequences listed in table 3 in the Examples section).

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 236, 237, 238, 239, 240 and 590.

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 241, 591 and 719 (see motif sequences listed in table 3 in the Examples section).

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 46, 47, 48, 285, 286, 287, 288, 289, 290, 291, 292, 293, 294, 295, 296, 297, 298, 299, 300, 301, 302, 303, 304, 305, 613, 614, 615, 616, 617, 618, 619, 620, 621, 622, 623, 624, 625, 626, 627, 628, 629, 630, 631, 632, 721, 722, 723, 724, 725, 726, 727, 728, 729, 730, 731, 732, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 800, 800, 800, 800, 801, 801, 802, 803, 804, 805, 806 and 807 (see motif sequences listed in table 3 in the Examples section).

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 331, 332, 638, 639, 640, 808, 809, 810, 811, 812, 813, 814 and 815 (see motif sequences listed in table 3 in the Examples section).

In some embodiments, the antisense oligonucleotide or contiguous nucleotide sequence comprises or consists of 10 to 30 nucleotides in length with at least 90% identity, preferably 100% identity to a sequence selected from the group consisting of SEQ ID NO: 409, 410, 411, 642, 643, 644, 645, 646, 816, 818 and 818 (see motif sequences listed in table 3 in the Examples section).

It is understood that the contiguous nucleobase sequences (motif sequence) can be modified to for example increase nuclease resistance and/or binding affinity to the target nucleic acid. Modifications are described in the definitions and in the "Oligonucleotide design" section. Table 3 lists preferred designs of each motif sequence.

Oligonucleotide Design

Oligonucleotide design refers to the pattern of nucleoside sugar modifications in the oligonucleotide sequence. The oligonucleotides of the invention comprise sugar-modified nucleosides and may also comprise DNA or RNA nucleosides. In some embodiments, the oligonucleotide comprises sugar-modified nucleosides and DNA nucleosides. Incorporation of modified nucleosides into the oligonucleotide of the invention may enhance the affinity of the oligonucleotide for the target nucleic acid. In that case, the modified nucleosides can be referred to as affinity enhancing modified nucleotides.

In an embodiment, the oligonucleotide comprises at least 1 modified nucleoside, such as at least 2, at least 3, at least 4, at least 5, at least 6, at least 7, at least 8, at least 9, at least 10, at least 11, at least 12, at least 13, at least 14, at least 15 or at least 16 modified nucleosides. In an embodiment the oligonucleotide comprises from 1 to 10 modified nucleosides, such as from 2 to 9 modified nucleosides, such as from 3 to 8 modified nucleosides, such as from 4 to 7 modified nucleosides, such as 6 or 7 modified nucleosides. In some embodiments, at least 1 of the modified nucleosides is a locked nucleic acid (LNA), such as at least 2, such as at least 3, at least 4, at least 5, at least 6, at least 7, or at least 8 of the modified nucleosides are LNA. In a still further embodiment all the modified nucleosides are LNA.

In an embodiment, the oligonucleotide of the invention may comprise modifications, which are independently selected from these three types of modifications (modified sugar, modified nucleobase and modified internucleoside linkage) or a combination thereof. Preferably the oligonucleotide comprises one or more sugar modified nucleosides, such as 2' sugar modified nucleosides. Preferably the oligonucleotide of the invention comprise the one or more 2' sugar modified nucleoside independently selected from the group consisting of 2'-O-alkyl-RNA, 2'-O-methyl-RNA, 2'-alkoxy-RNA, 2'-O-methoxyethyl-RNA, 2'-amino-DNA, 2'-fluoro-DNA, arabino nucleic acid (ANA), 2'-fluoro-ANA and LNA nucleosides. Even more preferably the one or more modified nucleoside is LNA.

In a further embodiment the oligonucleotide comprises at least one modified internucleoside linkage. In a preferred embodiment the internucleoside linkages within the contiguous nucleotide sequence are phosphorothioate or boranophosphate internucleoside linkages.

In some embodiments, the oligonucleotide of the invention comprise at least one modified nucleoside which is a 2'-MOE-RNA, such as 2, 3, 4, 5, 6, 7, 8, 9 or 10 2'-MOE-RNA nucleoside units. In some embodiments, at least one of said modified nucleoside is 2'-fluoro DNA, such as 2, 3, 4, 5, 6, 7, 8, 9 or 10 2'-fluoro-DNA nucleoside units.

In some embodiments, the oligonucleotide of the invention comprises at least one LNA unit, such as 1, 2, 3, 4, 5, 6, 7, or 8 LNA units, such as from 2 to 6 LNA units, such as from 3 to 7 LNA units, 4 to 8 LNA units or 3, 4, 5, 6 or 7 LNA units. In some embodiments, all the modified nucleosides are LNA nucleosides. In a further embodiment, the oligonucleotide may comprise both beta-D-oxy-LNA, and one or more of the following LNA units: thio-LNA, amino-LNA, oxy-LNA, and/or ENA in either the beta-D or alpha-L configurations or combinations thereof. In a further embodiment, all LNA cytosine units are 5-methyl-cytosine. In a preferred embodiment the oligonucleotide or contiguous nucleotide sequence has at least 1 LNA unit at the 5' end and at least 2 LNA units at the 3' end of the nucleotide sequence.

In some embodiments, the oligonucleotide of the invention comprises at least one LNA unit and at least one 2' substituted modified nucleoside.

In some embodiments of the invention, the oligonucleotide comprise both 2' sugar modified nucleosides and DNA units. Preferably the oligonucleotide comprise both LNA and DNA units. Preferably, the combined total of LNA and DNA units is 8-30, such as 10-25, preferably 12-22, such as 12-18, even more preferably 11-16. In some embodiments of the invention, the nucleotide sequence of the oligonucleotide, such as the contiguous nucleotide sequence consists of at least one or two LNA units and the remaining nucleotide units are DNA units. In some embodiments the oligonucleotide comprises only LNA nucleosides and naturally occurring nucleosides (such as RNA or DNA, most preferably DNA nucleosides), optionally with modified internucleoside linkages such as phosphorothioate.

In an embodiment of the invention the oligonucleotide of the invention is capable of recruiting RNase H.

Gapmer Design

In a preferred embodiment the oligonucleotide of the invention has a gapmer design or structure also referred herein merely as "Gapmer". In a gapmer structure the oligonucleotide comprises at least three distinct structural regions a 5'-flank, a gap and a 3'-flank, F-G-F' in '5→3' orientation. In this design, flanking regions F and F' (also termed wing regions) comprise a contiguous stretch of modified nucleosides, which are complementary to the UBE3A target nucleic acid, while the gap region, G, comprises a contiguous stretch of nucleotides which are capable of recruiting a nuclease, preferably an endonuclease such as RNase, for example RNase H, when the oligonucleotide is in duplex with the target nucleic acid. Nucleosides which are capable of recruiting a nuclease, in particular RNase H, can be selected from the group consisting of DNA, alpha-L-oxy-LNA, 2'-Flouro-ANA and UNA. Regions F and F', flanking the 5' and 3' ends of region G, preferably comprise non-nuclease recruiting nucleosides (nucleosides with a 3' endo structure), more preferably one or more affinity enhancing modified nucleosides. In some embodiments, the 3' flank comprises at least one LNA nucleoside, preferably at least 2 LNA nucleosides. In some embodiments, the 5' flank comprises at least one LNA nucleoside. In some embodiments both the 5' and 3' flanking regions comprise a LNA nucleoside. In some embodiments all the nucleosides in the flanking regions are LNA nucleosides. In other embodiments, the flanking regions may comprise both LNA nucleosides and other nucleosides (mixed flanks), such as DNA nucleosides and/or non-LNA modified nucleosides, such as 2' substituted nucleosides. In this case the gap is defined as a contiguous sequence of at least 5 RNase H recruiting nucleosides (nucleosides with a 2' endo structure, preferably DNA) flanked at the 5' and 3' end by an affinity enhancing modified nucleoside, preferably LNA, such as beta-D-oxy-LNA. Consequently, the nucleosides of the 5' flanking region and the 3' flanking region which are adjacent to the gap region are modified nucleosides, preferably non-nuclease recruiting nucleosides. In oligonucleotides with mixed flanks where the flanks comprise DNA the 5' and 3' nucleosides are modified nucleosides.

Region F

Region F (5' flank or 5' wing) attached to the '5 end of region G comprises, contains or consists of at least one modified nucleoside such as at least 2, at least 3, at least 4, at least 5, at least 6, at least 7 modified nucleosides. In an embodiment region F comprises or consists of from 1 to 7 modified nucleosides, such as from 2 to 6 modified nucleosides, such as from 2 to 5 modified nucleosides, such as from 2 to 4 modified nucleosides, such as from 1 to 3 modified nucleosides, such as 1, 2, 3 or 4 modified nucleosides. In a further embodiment further additional nucleosides may be attached to the '5 end of region F, representing a region D preferably comprising 1, 2 or 3 nucleoside units, such as DNA nucleosides. Region D can take the function of a biocleavable (B) linker described in the definition of "Linkers".

In some embodiments, the modified nucleosides in region F have a 3' endo structure.

In an embodiment, one or more of the modified nucleosides in region F are 2' modified nucleosides.

In a further embodiment one or more of the 2' modified nucleosides in region F are selected from 2'-O-alkyl-RNA units, 2'-O-methyl-RNA, 2'-amino-DNA units, 2'-fluoro-DNA units, 2'-alkoxy-RNA, MOE units, LNA units, arabino nucleic acid (ANA) units and 2'-fluoro-ANA units.

In one embodiment of the invention all the modified nucleosides in region F are LNA nucleosides. In a further embodiment the LNA nucleosides in region F are independently selected from the group consisting of oxy-LNA, thio-LNA, amino-LNA, cET, and/or ENA, in either the beta-D or alpha-L configurations or combinations thereof. In a preferred embodiment region F has at least 1 beta-D-oxy LNA unit, at the 5' end of the contiguous sequence.

Region G

Region G (gap region) preferably comprise, contain or consist of at least 4, such as at least 5, such as at least 6, at least 7, at least 8, at least 9, at least 10, at least 11, at least 12, at least 13, at least 14, at least 15 or at least 16 consecutive nucleosides capable of recruiting the aforementioned nuclease, in particular RNaseH. In a further embodiment region G comprise, contain or consist of from 5 to 12, or from 6 to 10 or from 7 to 9, such as 8 consecutive nucleotide units capable of recruiting aforementioned nuclease.

The nucleoside units in region G, which are capable of recruiting nuclease are in an embodiment selected from the group consisting of DNA, alpha-L-LNA, C4' alkylated DNA (as described in PCT/EP2009/050349 and Vester et al., Bioorg. Med. Chem. Lett. 18 (2008) 2296-2300, both incorporated herein by reference), arabinose derived nucleosides like ANA and 2'F-ANA (Mangos et al. 2003 J. AM. CHEM. SOC. 125, 654-661), UNA (unlocked nucleic acid) (as described in Fluiter et al., Mol. Biosyst., 2009, 10, 1039 incorporated herein by reference). UNA is unlocked nucleic acid, typically where the bond between C2 and C3 of the ribose has been removed, forming an unlocked "sugar" residue.

In a still further embodiment at least one nucleoside unit in region G is a DNA nucleoside unit, such as from 1 to 16 DNA units, such as 2, 3, 4, 5, 6, 7, 8, 9, 10, 11, 12, 13, 14 or 15 DNA units, preferably from 2 to 13 DNA units, such as from 4 to 12 DNA units, more preferably from 5 to 11, or from 10 to 16, 11 to 15 or 12 to 14 DNA units. In some embodiments, region G consists of 100% DNA units. In a preferred embodiment G consists of, most preferably 10, 11, 12, 13, 14 or 15 DNA units.

In further embodiments the region G may consist of a mixture of DNA and other nucleosides capable of mediating RNase H cleavage. Region G may consist of at least 50% DNA, more preferably 60%, 70% or 80% DNA, and even more preferred 90% or 95% DNA.

In a still further embodiment at least one nucleoside unit in region G is an alpha-L-LNA nucleoside unit, such as at least one alpha-L-LNA unit, such as 2, 3, 4, 5, 6, 7, 8 or 9 alpha-L-LNA units. In a further embodiment, region G comprises the least one alpha-L-LNA is alpha-L-oxy-LNA unit. In a further embodiment region G comprises a combination of DNA and alpha-L-LNA nucleoside units.

In some embodiments the size of the contiguous sequence in region G may be longer, such as 15, 16, 17, 18, 19 or 20 nucleoside units.

In some embodiments, nucleosides in region G have a 2' endo structure.

Region F'

Region F' (3' flank or 3' wing) attached to the '3 end of region G comprises, contains or consists of at least one modified nucleoside such as at least 2, at least 3, at least 4, at least 5, at least 6, at least 7 modified nucleosides. In an embodiment region F' comprise or consist of from 1 to 7 modified nucleosides, such as from 2 to 6 modified nucleoside, such as from 2 to 4 modified nucleosides, such as from 1 to 3 modified nucleosides, such as 1, 2, 3 or 4 modified nucleosides. In a further embodiment further additional nucleosides attached to the '3 end of region F', representing a region D', preferably comprising 1, 2 or 3 nucleoside units, such as DNA nucleosides. Region D' can take the function of a biocleavable (B) linker described, in the section "Linkers".

In some embodiments, the modified nucleosides in region F' have a 3' endo structure.

In a preferred embodiment, modified nucleosides in region F' is LNA.

In a further embodiment modified nucleosides in region F' are selected from 2'-O-alkyl-RNA units, 2'-O-methyl-RNA, 2'-amino-DNA units, 2'-fluoro-DNA units, 2'-alkoxy-RNA, MOE units, LNA units, arabino nucleic acid (ANA) units and 2'-fluoro-ANA units.

In one embodiment of the invention all the modified nucleosides in region F' are LNA nucleosides. In a further embodiment the LNA nucleosides in region F' are independently selected from the group consisting of oxy-LNA, thio-LNA, amino-LNA, cET and/or ENA, in either the beta-D or alpha-L configurations or combinations thereof. In a preferred embodiment region F' has at least 2 beta-D-oxy LNA unit, at the 3' end of the contiguous sequence.

Region D and D'

Region D and D' can be attached to the 5' end of region F or the 3' end of region F', respectively.

Region D or D' may independently comprise 1, 2, 3, 4 or 5 additional nucleotides, which may be complementary or non-complementary to the target nucleic acid. In this respect the oligonucleotide of the invention, may in some embodiments comprise a contiguous nucleotide sequence capable of modulating the target which is flanked at the 5' and/or 3' end by additional nucleotides. Such additional nucleotides may serve as a nuclease susceptible biocleavable linker (see definition of linkers). In some embodiments the additional 5' and/or 3' end nucleotides are linked with phosphodiester linkages, and may be DNA or RNA. In another embodiment, the additional 5' and/or 3' end nucleotides are modified nucleotides which may for example be included to enhance nuclease stability or for ease of synthesis. In an embodiment of the oligonucleotide of the invention, comprises a region D and/or D' in addition to the contiguous nucleotide sequence.

The gapmer oligonucleotide of the present invention can be represented by the following formulae:

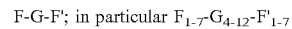

F-G-F'; in particular $F_{1-7}$-$G_{4-12}$-$F'_{1-7}$

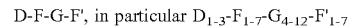

D-F-G-F', in particular $D_{1-3}$-$F_{1-7}$-$G_{4-12}$-$F'_{1-7}$

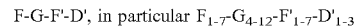

F-G-F'-D', in particular $F_{1-7}$-$G_{4-12}$-$F'_{1-7}$-$D'_{1-3}$

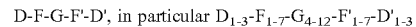

D-F-G-F'-D', in particular $D_{1-3}$-$F_{1-7}$-$G_{4-12}$-$F'_{1-7}$-$D'_{1-3}$

The preferred number and types of nucleosides in regions F, G and F', D and D' have been described above. The design of the individual oligonucleotide may also have profound impact on the properties of the oligonucleotide in its use for modulating expression of UBE3A.

In some embodiments the oligonucleotide is a gapmer consisting of 14, 15, 16, 17, 18, 19 or 20 nucleotides in length, wherein each of regions F and F' independently consists of 2, 3 or 4 modified nucleoside units complementary to a part of the human SNHG14 long non-coding RNA which is antisense to the UBE3A pre-mRNA (the target nucleic acid) and region G consists of 10, 11, 12, 13, 14 or 15 nucleoside units, capable of recruiting nuclease when in duplex with the target nucleic acid.

In a further embodiments, the oligonucleotide is a gapmer wherein each of regions F and F' independently consists of 2, 3, 4 or 5 modified nucleoside units, such as nucleoside units containing a 2'-O-methoxyethyl-ribose sugar (2'-MOE) or nucleoside units containing a 2'-fluoro-deoxyribose sugar and/or LNA units, and region G consists of 9, 10, 11, 12, 13, 14 or 15 nucleoside units, such as DNA units or other nuclease recruiting nucleosides such as alpha-L-LNA or a mixture of DNA and nuclease recruiting nucleosides.

In a further specific embodiment, the oligonucleotide is a gapmer wherein each of regions F and F' region consists of two LNA units each, and region G consists of 10, 11, 12, 13, 14 or 15 nucleoside units, preferably DNA units. Specific gapmer designs of this nature include 2-10-2, 2-11-2, 2-12-2, 2-13-2, 2-14-2 and 2-15-2.

In a further specific embodiment, the oligonucleotide is a gapmer wherein each of regions F and F' independently consists of three LNA units, and region G consists of 10, 11, 12, 13, 14 or 15 nucleoside units, preferably DNA units. Specific gapmer designs of this nature include 3-10-3, 3-11-3, 3-12-3, 3-13-3, 3-14-3 and 3-15-3.

In a further specific embodiment, the oligonucleotide is a gapmer wherein each of regions F and F' consists of four LNA units each, and region G consists of 10, 11, 12, 13, 14 or 15 nucleoside units, preferably DNA units. Specific gapmer designs of this nature include 4-10-4, 4-11-4, 4-12-4, 4-13-4, 4-14-4 and 4-15-4.

Specific gapmer designs of this nature include F-G-F' designs selected from a group consisting of a gap with 10 nucleosides and independently 1 to 4 modified nucleosides in the wings including 1-10-1, 2-10-1, 1-10-2, 1-10-3, 3-10-1, 1-10-4, 4-10-1, 2-10-2, 2-10-3, 3-10-2, 2-10-4, 4-10-2, 3-10-3, 3-10-4, 4-10-3 and 4-10-4 gapmers.

Specific gapmer designs of this nature include F-G-F' designs selected from a group consisting of a gap with 11 nucleosides and independently 1 to 4 modified nucleosides in the wings including, 1-11-1, 2-11-1, 1-11-2, 1-11-3, 3-11-1, 1-11-4, 4-11-1, 2-11-2, 2-11-3, 3-11-2, 2-11-4, 4-11-2, 3-11-3, 3-11-4, 4-11-3 and 4-11-4 gapmers.

Specific gapmer designs of this nature include F-G-F' designs selected from a group consisting of a gap with 12 nucleosides including, 1-12-1, 2-12-1, 1-12-2, 1-12-3, 3-12-1, 1-12-4, 4-12-1, 2-12-2, 2-12-3, 3-12-2, 2-12-4, 4-12-2, 3-12-3, 3-12-4, 4-12-3 and 4-12-4 gapmers.

Specific gapmer designs of this nature include F-G-F' designs selected from a group consisting of a gap with 13 nucleosides and independently 1 to 4 modified nucleosides in the wings including 1-13-1, 1-13-2, 1-13-3, 3-13-1, 1-13-4, 4-13-1, 2-13-1, 2-13-2, 2-13-3, 3-13-2, 2-13-4, 4-13-2, 3-13-3, 3-13-4, 4-13-3, and 4-13-4 gapmers.

Specific gapmer designs of this nature include F-G-F' designs selected from a group consisting of a gap with 14 nucleosides and independently 1 to 4 modified nucleosides in the wings including 1-14-1, 1-14-2, 2-14-1, 1-14-3, 3-14-1, 1-14-4, 4-14-1, 2-14-2, 2-14-3, 3-14-2 2-14-4, 4-14-2, 3-14-3, 3-14-4 and 4-14-3 gapmers.

Specific gapmer designs of this nature include F-G-F' designs selected from a group consisting of a gap with 15 nucleosides and independently 1 to 4 modified nucleosides in the wings including 1-15-1, 1-15-2, 2-15-1, 1-15-3, 3-15-1, 1-15-4, 4-15-1, 2-15-2, 2-15-3, 3-15-2 2-15-4, 4-15-2, 3-15-3, 3-15-4 and 4-15-3 gapmers.

Specific gapmer designs of this nature include F-G-F' designs selected from a group consisting of a gap with 16 nucleosides and independently 1 to 4 modified nucleosides in the wings including 1-16-1, 1-16-2, 2-16-1, 1-15-3, 3-16-1, 1-16-4, 4-16-1, 2-16-2, 2-16-3, 3-16-2 2-16-4, 4-16-2, 3-16-3, 3-16-4 and 4-16-3 gapmers.

In some embodiments the F-G-F' design is selected from 2-10-4, 3-10-3 and 4-10-2.

In some embodiments the F-G-F' design is selected from 2-11-4, 3-11-2, 3-11-3 and 4-11-2.

In some embodiments the F-G-F' design is selected from 2-12-2, 2-12-3, 2-12-4, 3-12-2, 3-12-3, and 4-12-2.

In some embodiments the F-G-F' design is selected from 2-13-2, 2-13-3, 2-13-4, 3-13-3 and 4-13-2.

In some embodiments the F-G-F' design is selected from 2-14-2, 2-14-4, 3-14-3 and 4-14-2.

In some embodiments the F-G-F' design is selected from 2-15-2 and 2-16-2.

In some embodiments the F-G-F' design is selected from the designs indicated in table 3.

In all instances the F-G-F' design may further include region D and/or D', which may have 1, 2 or 3 nucleoside units, such as DNA units. Preferably, the nucleosides in region F and F' are modified nucleosides, while nucleotides in region G are preferably unmodified nucleosides.

In each design, the preferred modified nucleoside is LNA.

In another embodiment all the internucleoside linkages in the gap in a gapmer are phosphorothioate and/or boranophosphate linkages. In another embodiment all the internucleoside linkages in the flanks (F and F' region) in a gapmer are phosphorothioate and/or boranophosphate linkages. In another preferred embodiment all the internucleoside linkages in the D and D' region in a gapmer are phosphodiester linkages.

For specific gapmers as disclosed herein, when the cytosine (C) residues are annotated as 5-methyl-cytosine, in various embodiments, one or more of the C's present in the oligonucleotide may be unmodified C residues.

Further gapmer designs are disclosed in WO2004/046160, WO2007/146511 and incorporated by reference.

For certain embodiments of the invention, the oligonucleotide is selected from the group of oligonucleotide compounds in table 3.

For certain embodiments of the invention, the oligonucleotide is selected from the group of oligonucleotide compounds with CMP-ID-NO: 4_1 to 150_2.

For certain embodiments of the invention, the oligonucleotide is selected from the group of oligonucleotide compounds with CMP-ID-NO: 4_1 to 678_1.

For certain embodiments of the invention, the oligonucleotide is selected from the group of oligonucleotide compounds with CMP-ID-NO: 4_1 to 818_1 (see oligonucleotide sequences listed in table 3 in the Examples section).

For certain embodiments of the invention, the oligonucleotide is an oligonucleotide compound with CMP-ID-NO: 155_1 or 165_1.

For certain embodiments of the invention, the oligonucleotide is selected from the group of oligonucleotide compounds with CMP-ID-NO: 169_52, 169_50 or 169_56.

For certain embodiments of the invention, the oligonucleotide is selected from the group of oligonucleotide compounds with CMP-ID-NO: 172_1, 272_1, 572_7, 572_6 or 572_5.

For certain embodiments of the invention, the oligonucleotide is an oligonucleotide compound with CMP-ID-NO: 175_1.

For certain embodiments of the invention, the oligonucleotide is an oligonucleotide compound with CMP-ID-NO: 178_1.

For certain embodiments of the invention, the oligonucleotide is selected from the group of oligonucleotide compounds with CMP-ID-NO: 573_8, 186_1 or 187_1.

For certain embodiments of the invention, the oligonucleotide is an oligonucleotide compound with CMP-ID-NO: 186_1.

For certain embodiments of the invention, the oligonucleotide is selected from the group of oligonucleotide compounds with CMP-ID-NO: 200_1, 204_1, 206_1, 35_2 or 209_1.

For certain embodiments of the invention, the oligonucleotide is selected from the group of oligonucleotide compounds with CMP-ID-NO: 585_1, 585_8, 586_9, 586_5, 586_8, 586_4 or 586_6.

For certain embodiments of the invention, the oligonucleotide is an oligonucleotide compound with CMP-ID-NO: 233_1.

For certain embodiments of the invention, the oligonucleotide is an oligonucleotide compound with CMP-ID-NO: 237_8 or 590_13.

For certain embodiments of the invention, the oligonucleotide is an oligonucleotide compound with CMP-ID-NO: 220_1.

For certain embodiments of the invention, the oligonucleotide is selected from the group of oligonucleotide compounds with CMP-ID-NO: 591_1, 592_2, 592_4 or 241_9.

For certain embodiments of the invention, the oligonucleotide is selected from the group of oligonucleotide compounds with CMP-ID-NO: 597_4, 598_4, 39_1 or 602_1.

For certain embodiments of the invention, the oligonucleotide is an oligonucleotide compound with CMP-ID-NO: 39_1.

For certain embodiments of the invention, the oligonucleotide is an oligonucleotide compound with CMP-ID-NO: 611_7.

For certain embodiments of the invention, the oligonucleotide is an oligonucleotide compound with CMP-ID-NO: 271_1 or 278_1.

For certain embodiments of the invention, the oligonucleotide is selected from the group of oligonucleotide compounds with CMP-ID-NO: 616_4, 621_2, 621_1, 622_3, 622_5, 622_4, 6243, 624_5, 287_1, 625_6, 626_7, 626_8, 626_9, 48_1, 631_6, 631_1, 303_1, 304_6 or 304_10.

For certain embodiments of the invention, the oligonucleotide is an oligonucleotide compound with CMP-ID-NO: 636_8.

For certain embodiments of the invention, the oligonucleotide is selected from the group of oligonucleotide compounds with CMP-ID-NO: 638_8, 639_5, 331_1 or 640_4.

For certain embodiments of the invention, the oligonucleotide is selected from the group of oligonucleotide compounds with CMP-ID-NO: 359_1, 361_1, 361_5, 362_1 or 641_5.

For certain embodiments of the invention, the oligonucleotide is selected from the group of oligonucleotide compounds with CMP-ID-NO: 378_1, 379_1, 399_1.

For certain embodiments of the invention, the oligonucleotide is selected from the group of oligonucleotide compounds with CMP-ID-NO: 403_1, 405_1, 642_12, 642_13, 644_3 or 646_16.

For certain embodiments of the invention, the oligonucleotide is an oligonucleotide compound with CMP-ID-NO: 85_1 or 425_5.

For certain embodiments of the invention, the oligonucleotide is an oligonucleotide compound with CMP-ID-NO: 116_1.

For certain embodiments of the invention, the oligonucleotide is an oligonucleotide compound with CMP-ID-NO: 123_1 or 124_1.

For certain embodiments of the invention, the oligonucleotide is an oligonucleotide compound with CMP-ID-NO: 126_2.

Method of Manufacture

In a further aspect, the invention provides methods for manufacturing the oligonucleotides of the invention comprising reacting nucleotide units and thereby forming covalently linked contiguous nucleotide units comprised in the oligonucleotide. Preferably, the method uses phophoramidite chemistry (see for example Caruthers et al, 1987, Methods in Enzymology vol. 154, pages 287-313). In a further embodiment the method further comprises reacting the contiguous nucleotide sequence with a conjugating moiety (ligand). In a further aspect a method is provided for manufacturing the composition of the invention, comprising mixing the oligonucleotide or conjugated oligonucleotide of the invention with a pharmaceutically acceptable diluent, solvent, carrier, salt and/or adjuvant.

Pharmaceutical Composition

In a further aspect, the invention provides pharmaceutical compositions comprising any of the aforementioned oligonucleotides and/or oligonucleotide conjugates and a pharmaceutically acceptable diluent, carrier, salt and/or adjuvant. A pharmaceutically acceptable diluent includes phosphate-buffered saline (PBS) and pharmaceutically acceptable salts include, but are not limited to, sodium and potassium salts.

WO 2007/031091 provides suitable and preferred examples of pharmaceutically acceptable diluents, carriers and adjuvants (hereby incorporated by reference). Suitable dosages, formulations, administration routes, compositions, dosage forms, combinations with other therapeutic agents, pro-drug formulations are also provided in WO2007/031091.

Oligonucleotides or oligonucleotide conjugates of the invention may be mixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

In some embodiments, the oligonucleotide or oligonucleotide conjugate of the invention is a prodrug. In particular with respect to oligonucleotide conjugates the conjugate moiety is cleaved of the oligonucleotide once the prodrug is delivered to the site of action, e.g. the target cell.

Applications

The oligonucleotides of the invention may be utilized as research reagents for, for example, therapeutics and prophylaxis.

In research, such oligonucleotides may be used to specifically modulate the synthesis of UBE3A protein in cells (e.g. in vitro cell cultures) and experimental animals thereby facilitating functional analysis of the target or an appraisal of its usefulness as a target for therapeutic intervention. The target modulation is achieved by degrading or inhibiting a modulator of the gene or mRNA producing the protein.

For therapeutics, an animal or a human, suspected of having a disease or disorder, which can be treated by modulating the expression of UBE3A.

The invention provides methods for treating or preventing a disease, comprising administering a therapeutically or prophylactically effective amount of an oligonucleotide, an oligonucleotide conjugate or a pharmaceutical composition of the invention to a subject suffering from or susceptible to the disease.

The invention also relates to an oligonucleotide, a composition or a conjugate as defined herein for use as a medicament.

The oligonucleotide, oligonucleotide conjugate or a pharmaceutical composition according to the invention is typically administered in an effective amount.

The invention also provides for the use of the oligonucleotide or oligonucleotide conjugate of the invention as described for the manufacture of a medicament for the treatment of a disorder as referred to herein, or for a method of the treatment of as a disorder as referred to herein.

The disease or disorder, as referred to herein, is associated with expression of UBE3A. In some embodiments the disease or disorder may be associated with a mutation in the maternal UBE3A gene. In some embodiments, the target nucleic acid is a regulator of the paternal UBE3A gene.

The methods of the invention are preferably employed for treatment or prophylaxis against diseases caused by abnormal levels and/or activity of UBE3A. The disease may in particular be caused by reduced levels and/or activity of UBE3A protein.

The invention further relates to use of an oligonucleotide, oligonucleotide conjugate or a pharmaceutical composition as defined herein for the manufacture of a medicament for the treatment of abnormal levels and/or activity of UBE3A, in particular low levels and/or activity of UBE3A.

In one embodiment, the invention relates to oligonucleotides, oligonucleotide conjugates or pharmaceutical compositions for use in the treatment of Angelman syndrome.

Administration

The oligonucleotides or pharmaceutical compositions of the present invention may be administered topical (such as, to the skin, inhalation, ophthalmic or otic) or enteral (such as, orally or through the gastrointestinal tract) or parenteral (such as, intravenous, subcutaneous, intra-muscular, intracerebral, intracerebroventricular or intrathecal).

In a preferred embodiment the oligonucleotide or pharmaceutical compositions of the present invention are administered by a parenteral route including intravenous, intraarterial, subcutaneous, intraperitoneal or intramuscular injection or infusion, intrathecal or intracranial, e.g., intracerebral or intraventricular, administration. In one embodiment the active oligonucleotide or oligonucleotide conjugate is administered intracerebral or intracerebroventricular. In another embodiment the active oligonucleotide or oligonucleotide conjugate is administered intrathecal.

The invention also provides for the use of the oligonucleotide or oligonucleotide conjugate of the invention as described for the manufacture of a medicament wherein the medicament is in a dosage form for intrathecal administration.

The invention also provides for the use of the oligonucleotide or oligonucleotide conjugate of the invention as described for the manufacture of a medicament wherein the medicament is in a dosage form for intracerebral or intraventricular administration.

The invention also provides for the use of the oligonucleotide or oligonucleotide conjugate of the invention as described for the manufacture of a medicament wherein the medicament is in a dosage form for intracerebroventricular administration.

Combination Therapies

In some embodiments the oligonucleotide, oligonucleotide conjugate or pharmaceutical composition of the invention is for use in a combination treatment with another therapeutic agent. The therapeutic agent can for example be anticonvulsant medication.

EMBODIMENTS

The following embodiments of the present invention may be used in combination with any other embodiments described herein.

1. An antisense oligonucleotide which comprises or consists of a contiguous nucleotide sequence of 10 to 30 nucleotides in length capable of inducing human paternal UBE3A expression, in particular in a neuronal cell.

2. The oligonucleotide of embodiment 1, wherein the contiguous nucleotide sequence is at least 95% complementarity to the part of human SNHG14 long non-coding RNA which is downstream of SNORD109B corresponding to position 25278410 to 25419462 on chromosome 15.

3. The oligonucleotide of embodiment 1 or 2, wherein the oligonucleotide is capable of hybridizing to a target nucleic acid of SEQ ID NO: 1 with a $\Delta G°$ below −10 kcal.

4. The oligonucleotide of embodiment 1-3, wherein the contiguous nucleotide sequence is at least 95%, such as 98%, such as 100% complementarity to region of the target nucleic acid of SEQ ID NO: 1 and/or 2.

5. The oligonucleotide of embodiment 1-3, wherein the contiguous nucleotide sequence is 100% complementary to a region of the target nucleic acid of position 1 to 55318 of SEQ ID NO: 1.

6. The oligonucleotide of embodiment 1-4, wherein the contiguous nucleotide sequence is complementary to a subsequence of the target nucleic acid, wherein the subsequence is selected from the group consisting of the regions indicated in table 1 or 2.

7. The oligonucleotide of embodiment 1-4, wherein the contiguous nucleotide sequence is at least 98% complementarity to the part of human SNHG14 long non-coding RNA which is antisense to the UBE3A pre-mRNA.

8. The oligonucleotide of embodiments 1-4 or 7, wherein the oligonucleotide is capable of hybridizing to a target nucleic acid corresponding to position 55319 to 141053 of SEQ ID NO: 1, with a $\Delta G°$ below −10 kcal.

9. The oligonucleotide of embodiments 1-4 or 7-8, wherein the contiguous nucleotide sequence is 100% complementary to a target nucleic acid of position 55319 to 141053 of SEQ ID NO: 1.

10. The oligonucleotide of embodiment 1-8, wherein the target nucleic acid is RNA.

11. The oligonucleotide of embodiment 10, wherein the RNA is a long non-coding RNA.

12. The oligonucleotide of embodiment 1-11, wherein the contiguous nucleotide sequence comprises or consists of at least 10 contiguous nucleotides, particularly 11, 12, 13, 14, 15, 16, 17, 18, 19, 20, 21, 22, 23, 24, 25, 26, 27, 28, or 29 contiguous nucleotides.

13. The oligonucleotide of embodiment 1-12, wherein the contiguous nucleotide sequence comprises or consists of from 12 to 22 nucleotides.

14. The oligonucleotide of embodiment 13, wherein the contiguous nucleotide sequence comprises or consists of from 15-20 nucleotides.

15. The oligonucleotide of embodiment 1-14, wherein the oligonucleotide comprises or consists of 10 to 35 nucleotides in length.

16. The oligonucleotide of embodiment 15, wherein the oligonucleotide comprises or consists of 15 to 24 nucleotides in length.

17. The oligonucleotide of embodiment 15 or 17, wherein the oligonucleotide comprises or consists of 17 to 22 nucleotides in length.

18. The oligonucleotide of embodiment 1-17, wherein the oligonucleotide or contiguous nucleotide sequence is single stranded.

19. The oligonucleotide of embodiment 1-18, wherein the contiguous nucleotide sequence is complementary to a subsequence of the target nucleic acid, selected from the group consisting of the regions indicated in table 1 or 2.

20. The oligonucleotide of embodiment 1-18, wherein the contiguous nucleotide sequence is complementary to a subsequence of the target nucleic acid selected from the group consisting of position 1589-10889, 46089-53989 and 60789-62489 of SEQ ID NO: 1.

21. The oligonucleotide of embodiment 1-18, wherein the contiguous nucleotide sequence is complementary to a subsequence of the target nucleic acid corresponding to positions 5218-5240 of SEQ ID NO: 1.

22. The oligonucleotide of embodiment 1-18, wherein the contiguous nucleotide sequence is complementary to a subsequence of the target nucleic acid corresponding to positions 5782-5803 of SEQ ID NO: 1.

23. The oligonucleotide of embodiment 1-18, wherein the contiguous nucleotide sequence is complementary to a subsequence of the target nucleic acid corresponding to positions 8113-8139 of SEQ ID NO: 1.

24. The oligonucleotide of embodiment 1-18, wherein the contiguous nucleotide sequence is complementary to a subsequence of the target nucleic acid corresponding to positions: 9200-9250 of SEQ ID NO: 1.

25. The oligonucleotide of embodiment 1-18, wherein the contiguous nucleotide sequence is complementary to a subsequence of the target nucleic acid corresponding to positions: 11505-11555 of SEQ ID NO: 1.

26. The oligonucleotide of embodiment 1-18, wherein the contiguous nucleotide sequence is complementary to a subsequence of the target nucleic acid corresponding to positions 13223-13242 of SEQ ID NO: 1.

27. The oligonucleotide of embodiment 1-18, wherein the contiguous nucleotide sequence is complementary to a subsequence of the target nucleic acid corresponding to positions 15100-15150 of SEQ ID NO: 1.

28. The oligonucleotide of embodiment 1-18, wherein the contiguous nucleotide sequence is complementary to a subsequence of the target nucleic acid corresponding to positions 15113-15180 of SEQ ID NO: 1.

29. The oligonucleotide of embodiment 1-18, wherein the contiguous nucleotide sequence is complementary to a subsequence of the target nucleic acid corresponding to positions 29635-29705 of SEQ ID NO: 1.

30. The oligonucleotide of embodiment 1-18, wherein the contiguous nucleotide sequence is complementary to a subsequence of the target nucleic acid corresponding to positions 30590-30740 of SEQ ID NO: 1.

31. The oligonucleotide of embodiment 1-18, wherein the contiguous nucleotide sequence is complementary to a subsequence of the target nucleic acid corresponding to positions 39800-39855 of SEQ ID NO: 1.

32. The oligonucleotide of embodiment 1-18, wherein the contiguous nucleotide sequence is complementary to a subsequence of the target nucleic acid corresponding to positions 44435-44460 of SEQ ID NO: 1.

33. The oligonucleotide of embodiment 1-18, wherein the contiguous nucleotide sequence is complementary to a subsequence of the target nucleic acid corresponding to positions 45245-45270 of SEQ ID NO: 1

34. The oligonucleotide of embodiment 1-18, wherein the contiguous nucleotide sequence is complementary to a subsequence of the target nucleic acid to positions 46380-46430 of SEQ ID NO: 1.

35. The oligonucleotide of embodiment 1-18, wherein the contiguous nucleotide sequence is complementary to a subsequence of the target nucleic acid corresponding to positions 68915-68940 of SEQ ID NO: 1.

36. The oligonucleotide of embodiment 1-35, wherein the oligonucleotide is neither siRNA nor self-complementary.

37. The oligonucleotide of embodiment 1-36, wherein the contiguous nucleotide sequence comprises or consists of a sequence selected from the group consisting of SEQ ID NO: 4, 5, 6, 7, 8, 9, 10, 11, 12, 13, 14, 15, 16, 17, 1819, 20, 21, 22, 23, 23, 24, 25, 26, 26, 27, 28, 29, 30, 31, 31, 32, 33, 34, 35, 36, 37, 38, 39, 40, 41, 42, 43, 44, 44, 45, 45, 46, 47, 48, 49, 50, 51, 52, 53, 53, 54, 54, 55, 56, 57, 58, 59, 60, 61, 62, 63, 64, 64, 65, 66, 67, 68, 69, 70, 71, 72, 73, 74, 75, 76, 77, 78, 79, 79, 80, 81, 8283, 84, 85, 86, 87, 88, 89, 90, 91, 92, 93, 94, 95, 95, 96, 96, 96, 97, 98, 99, 100, 101, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 702, 703, 704, 705, 706, 707, 708, 709, 710, 711, 712, 713, 714, 715, 716, 717, 718, 719, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 754, 755, 756, 757, 758, 759, 760, 761, 762, 763, 764, 765, 766, 767, 768, 769, 770, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817 and 818.

38. The oligonucleotide of embodiment 1-36, wherein the contiguous nucleotide sequence comprises or consists of a sequence selected from the group consisting of SEQ ID NO: 166, 167, 167 or 169 (see motif sequences listed in table 3 in the Examples section).

39. The oligonucleotide of embodiment 1-36, wherein the contiguous nucleotide sequence comprises or consists of a sequence selected from the group consisting of SEQ ID NO: 570, 571, 572, 679, 680, 681, 682 and 683 (see motif sequences listed in table 3 in the Examples section).

40. The oligonucleotide of embodiment 1-36, wherein the contiguous nucleotide sequence comprises or consists of a sequence selected from the group consisting of SEQ ID NO: 570, 571, 572, 679, 680, 681, 682 and 683 (see motif sequences listed in table 3 in the Examples section).

41. The oligonucleotide of embodiment 1-36, wherein the contiguous nucleotide sequence comprises or consists of a sequence selected from the group consisting of SEQ ID NO: 35, 199 to 210 or SEQ ID NO: 582 to 584 (see motif sequences listed in table 3 in the Examples section).

42. The oligonucleotide of embodiment 1-36, wherein the contiguous nucleotide sequence comprises or consists of a sequence selected from the group consisting of SEQ ID NO: 236, 237, 238, 239, 240 and 590 (see motif sequences listed in table 3 in the Examples section).

43. The oligonucleotide of embodiment 1-36, wherein the contiguous nucleotide sequence comprises or consists of a sequence selected from the group consisting of SEQ ID NO: 221 to 225 or SEQ ID NO: 585 to 589 (see motif sequences listed in table 3 in the Examples section).

44. The oligonucleotide of embodiment 1-36, wherein the contiguous nucleotide sequence comprises or consists of a sequence selected from the group consisting of SEQ ID NO: 241 or 591 (see motif sequences listed in table 3 in the Examples section).

45. The oligonucleotide of embodiment 1-36, wherein the contiguous nucleotide sequence comprises or consists of a sequence selected from the group consisting of SEQ ID NO: 46-48, 285 to 305 or SEQ ID NO: 613 to 632 or SEQ ID NO: 721 to 807 (see motif sequences listed in table 3 in the Examples section).

46. The oligonucleotide of embodiment 1-36, wherein the contiguous nucleotide sequence comprises or consists of a sequence selected from the group consisting of SEQ ID NO: 331, 332, 638, 639, 640, 808, 809, 810, 811, 812, 813, 814 and 815 (see motif sequences listed in table 3 in the Examples section).

47. The oligonucleotide of embodiment 1-36, wherein the contiguous nucleotide sequence comprises or consists of a sequence selected from the group consisting of SEQ ID NO: 409 to 411 or SEQ ID NO: 642 to 646 or SEQ ID NO: 816 to 818 (see motif sequences listed in table 3 in the Examples section).

48. The oligonucleotide of embodiment 1-47, wherein the contiguous nucleotide sequence has zero to three mismatches compared to the target nucleic acid it is complementary to.

49. The oligonucleotide of embodiment 48, wherein the contiguous nucleotide sequence has one mismatch compared to the target nucleic acid.

50. The oligonucleotide of embodiment 48, wherein the contiguous nucleotide sequence has two mismatches compared to the target nucleic acid.

51. The oligonucleotide of embodiment 48, wherein the contiguous nucleotide sequence is fully complementary to the target nucleic acid sequence.

52. The oligonucleotide of embodiment 1-51, comprising one or more modified nucleosides.

53. The oligonucleotide of embodiment 52, wherein the one or more modified nucleoside is a high-affinity modified nucleosides.

54. The oligonucleotide of embodiment 52 or 53, wherein the one or more modified nucleoside is a 2' sugar modified nucleoside.

55. The oligonucleotide of embodiment 54, wherein the one or more 2' sugar modified nucleoside is independently selected from the group consisting of 2'-O-alkyl-RNA, 2'-O-methyl-RNA, 2'-alkoxy-RNA, 2'-O-methoxyethyl-RNA, 2'-amino-DNA, 2'-fluoro-DNA, 2'-fluoro-ANA and LNA nucleosides.

56. The oligonucleotide of embodiment 54, wherein the one or more modified nucleoside is a LNA nucleoside.

57. The oligonucleotide of embodiment 56, wherein the modified LNA nucleoside is oxy-LNA.

58. The oligonucleotide of embodiment 57, wherein the modified nucleoside is beta-D-oxy-LNA.

59. The oligonucleotide of embodiment 57, wherein the modified nucleoside is alpha-L-oxy-LNA 60. The oligonucleotide of embodiment 56, wherein the modified nucleoside is thio-LNA.

61. The oligonucleotide of embodiment 56, wherein the modified nucleoside is amino-LNA.

62. The oligonucleotide of embodiment 56, wherein the modified nucleoside is cET.

63. The oligonucleotide of embodiment 56, wherein the modified nucleoside is ENA.

64. The oligonucleotide of embodiment 56, wherein the modified LNA nucleoside is selected from beta-D-oxy-LNA, alpha-L-oxy-LNA, beta-D-amino-LNA, alpha-L-amino-LNA, beta-D-thio-LNA, alpha-L-thio-LNA, (S)cET, (R)cET beta-D-ENA and alpha-L-ENA.

65. The oligonucleotide of any one of embodiments 1-64, wherein the oligonucleotide comprises at least one modified internucleoside linkage.

66. The oligonucleotide of embodiment 65, wherein the modified internucleoside linkage is nuclease resistant.

67. The oligonucleotide of embodiment 65 or 66, wherein at least 50% of the internucleoside linkages within the contiguous nucleotide sequence are phosphorothioate internucleoside linkages or boranophosphate internucleoside linkages.

68. The oligonucleotide of embodiment 65 or 66, wherein all the internucleoside linkages within the contiguous nucleotide sequence are phosphorothioate internucleoside linkages.

69. The oligonucleotide of embodiment 1-68, wherein the oligonucleotide is capable of recruiting RNase H.

70. The oligonucleotide of embodiment 69, wherein the oligonucleotide is a gapmer.

71. The oligonucleotide of embodiment 69 or 70, wherein the oligonucleotide is a gapmer of formula 5'-F-G-F'-3', where region F and F' independently comprise or consist of 1-7 modified nucleosides and G is a region between 6 and 16 nucleosides which are capable of recruiting RNaseH.

72. The oligonucleotide of embodiment 71, wherein the modified nucleoside is a 2' sugar modified nucleoside independently selected from the group consisting of 2'-O-alkyl-RNA, 2'-O-methyl-RNA, 2'-alkoxy-RNA, 2'-O-methoxyethyl-RNA, 2'-amino-DNA, 2'-fluoro-DNA, arabino nucleic acid (ANA), 2'-fluoro-ANA and LNA nucleosides.

73. The oligonucleotide of embodiment 71 or 72, wherein one or more of the modified nucleosides in region F and F' is a LNA nucleoside.

74. The oligonucleotide of embodiment 73, wherein all the modified nucleosides in region F and F' are LNA nucleosides.

75. The oligonucleotide of embodiment 74, wherein region F and F' consist of LNA nucleosides.

76. The oligonucleotide of embodiment 73-75, wherein all the modified nucleosides in region F and F' are oxy-LNA nucleosides.

77. The oligonucleotide of embodiment 73, wherein at least one of region F or F' further comprises at least one 2' substituted modified nucleoside independently selected from the group consisting of 2'-O-alkyl-RNA, 2'-O-methyl-RNA, 2'-alkoxy-RNA, 2'-O-methoxyethyl-RNA, 2'-amino-DNA and 2'-fluoro-DNA.

78. The oligonucleotide of embodiment 73-77, wherein the RNaseH recruiting nucleosides in region G are independently selected from DNA, alpha-L-LNA, C4' alkylated DNA, ANA and 2'F-ANA and UNA.

79. The oligonucleotide of embodiment 78, wherein the nucleosides in region G is DNA and/or alpha-L-LNA nucleosides.

80. The oligonucleotide of embodiment 78 or 79, wherein region G consists of at least 75% DNA nucleosides.

81. The oligonucleotide of embodiment 1-80, wherein the oligonucleotide is capable of increasing the expression of UBE3A by at least 30% compared to a control.

82. The oligonucleotide of embodiment 1-81, wherein the level of the SNHG14 transcript downstream of SNORD109B is reduced by at least 20% compared to a control.

83. The oligonucleotide of embodiment 1-82, wherein the expression of SNORD115 is not significantly affected compared to a control.

84. The oligonucleotide of embodiment 1-83, wherein the oligonucleotide is selected from CMP ID NO: 4_1 to 678_1.

85. The oligonucleotide of embodiment 1-83, wherein the oligonucleotide is selected from the group consisting of CMP ID NO: 4_1, 4_2, 5_1, 5_2, 6_1, 6_2, 7_1, 7_2, 8_1, 9_1, 10_1, 11_1, 11_2, 12_1, 12_2, 13_1, 13_2, 14_1, 15_1, 16_1, 17_1, 17_2, 18_1, 18_2, 19_1, 19_2, 20_1, 21_1, 22_1, 23_1, 23_2, 24_1, 25_1, 26_1, 26_2, 27_1, 28_1, 28_2, 29_1, 29_2, 30_1, 31_1, 31_2, 32_1, 33_1, 34_1, 34_2, 34_3, 34_4, 34_5, 34_6, 34_7, 35_1, 35_2, 36_1, 37_1, 38_1, 38_2, 38_3, 38_4, 38_5, 38_6, 39_1, 39_2, 39_3, 39_4, 39_5, 40_1, 40_2, 40_3, 40_4, 40_5, 40_6, 40_7, 40_8, 41_1, 42_1, 43_1, 44_1, 44_2, 45_1, 45_2, 46_1, 47_1, 48_1, 48_2, 48_3, 48_4, 48_5, 48_6, 48_7, 49_1, 50_1, 51_1, 52_1, 53_1, 53_2, 54_1, 54_2, 54_3, 55_1, 55_2, 56_1, 57_1, 58_1, 58_2, 58_3, 59_1, 59_2, 60_1, 60_2, 60_3, 61_1, 62_1, 63_1, 64_1, 64_2, 65_1, 66_1, 67_1, 68_1, 69_1, 69_2, 69_3, 70_1, 70_2, 70_3, 71_1, 72_1, 72_2, 73_1, 73_2, 73_3, 74_1, 74_2, 75_1, 75_2, 76_1, 77_1, 77_2, 77_3, 78_1, 79_1, 79_2, 79_3, 80_1, 80_2, 80_3, 81_1, 82_1, 82_2, 83_1, 83_2, 84_1, 84_2, 85_1, 85_2, 86_1, 87_1, 88_1, 88_2, 89_1, 90_1, 91_1, 92_1, 93_1, 94_1, 95_1, 95_2, 96_1, 96_2, 96_3, 97_1, 97_2, 97_3, 97_4, 98_1, 98_2, 98_3, 99_1, 99_2, 99_3, 99_4, 100_1, 100_2, 100_3, 101_1, 101_2, 101_3, 101_4, 102_1, 102_2, 102_3, 102_4, 103_1, 103_2, 103_3, 103_4, 104_1, 104_2, 104_3, 105_1, 105_2, 105_3, 105_4, 106_1, 106_2, 106_3, 106_4, 107_1, 107_2, 107_3, 107_4, 108_1, 108_2, 108_3, 108_4, 109_1, 109_2, 109_3, 109_4, 110_1, 110_2, 111_1, 111_2, 111_3, 112_1, 112_2, 113_1, 114_1, 115_1, 116_1, 117_1, 118_1, 119_1, 120_1, 120_2, 121_1, 122_1, 123_1, 124_1, 125_1, 126_1, 126_2, 127_1, 128_1, 128_2, 128_3, 128_4, 129_1, 129_2, 130_1, 131_1, 132_1, 132_2, 132_3, 133_1, 133_2, 133_3, 133_4, 134_1, 134_2, 135_1, 135_2, 136_1, 137_1, 138_1, 139_1, 140_1, 141_1, 142_1, 143_1, 144_1, 145_1, 145_2, 146_1, 146_2, 147_1, 148_1, 149_1, 150_1, 150_2, 151_1, 152_1, 153_1, 154_1, 155_1, 156_1, 157_1, 158_1, 159_1, 160_1, 161_1, 162_1, 163_1, 164_1, 165_1, 166_1, 167_1, 168_1, 169_1, 169_10, 169_11, 169_12, 169_13, 169_14, 169_15, 169_16, 169_17, 169_18, 169_19, 169_2, 169_20, 169_21, 169_22, 169_23, 169_24, 169_25, 169_26, 169_27, 169_28, 169_29, 169_3, 169_30, 169_31, 169_32, 169_33, 169_34, 169_35, 169_36, 169_37, 169_38, 169_39, 169_4, 169_40, 169_41, 169_42, 169_43, 169_44, 169_45, 169_46, 169_47, 169_48, 169_49, 169_5, 169_50, 169_51, 169_52, 169_53, 169_54, 169_55, 169_56, 169_57, 169_6, 169_7, 169_8, 169_9, 169_58, 169_59, 169_60, 169_61, 169_62, 170_1, 171_1, 172_1, 173_1, 174_1, 175_1, 176_1, 177_1, 178_1, 179_1, 180_1, 181_1, 182_1, 183_1, 184_1, 185_1, 186_1, 187_1, 188_1, 189_1, 190_1, 191_1, 192_1, 193_1, 194_1, 195_1, 196_1, 197_1, 198_1, 199_1, 200_1, 201_1, 202_1, 203_1, 204_1, 205_1, 206_1, 207_1, 208_1, 208_2, 208_3, 208_4, 208_5, 208_6, 208_7, 209_1, 209_10, 209_2, 209_3, 209_4, 209_5, 209_6, 209_7, 209_8, 209_9, 210_1, 211_1, 212_1, 213_1, 214_1, 215_1, 216_1, 217_1, 218_1, 219_1, 220_1, 221_1, 222_1, 223_1, 224_1, 225_1, 226_1, 227_1, 228_1, 229_1, 230_1, 231_1, 232_1, 233_1, 234_1, 235_1, 236_1, 236_10, 236_11, 236_12, 236_13, 236_14, 236_15, 236_16, 236_2, 236_3, 236_4, 236_5, 236_6, 236_7, 236_8, 236_9, 236_17, 236_18, 236_19, 236_20, 236_21, 237_1, 237_10, 237_11, 237_12, 237_13, 237_14, 237_15, 237_16, 237_2, 237_3, 237_4, 237_5, 237_6, 237_7, 237_8, 237_9, 237_17, 237_18, 237_19, 237_20, 237_21, 238_1, 239_1, 239_10, 239_11, 239_12, 239_13, 239_14, 239_15, 239_16, 239_2, 239_3, 239_4, 239_5, 239_6, 239_7, 239_8, 239_9, 239_17, 239_18, 239_19, 239_20, 239_21, 240_1, 241_1, 241_10, 241_2, 241_3, 241_4, 241_5, 241_6, 241_7, 241_8, 241_9, 241_11, 241_12, 241_13, 241_14, 241_15, 242_1, 243_1, 244_1, 244_2, 244_3, 244_4, 244_5, 245_1, 246_1, 247_1, 248_1, 249_1, 250_1, 251_1, 252_1, 253_1, 254_1, 255_1, 256_1, 257_1, 258_1, 259_1, 260_1, 261_1, 262_1, 263_1, 264_1, 265_1, 266_1, 267_1, 268_1, 269_1, 270_1, 271_1, 272_1, 273_1, 274_1, 275_1, 276_1, 277_1, 278_1, 279_1, 280_1, 281_1, 282_1, 283_1, 284_1, 285_1, 285_2, 285_3, 285_4, 285_5, 285_6, 285_7, 285_8, 285_9, 285_10, 285_11, 286_1, 287_1, 288_1, 289_1, 290_1, 291_1, 292_1, 293_1, 294_1, 295_1, 296_1, 297_1, 298_1, 299_1, 300_1, 301_1, 302_1, 303_1, 304_1, 304_10, 304_2, 304_3, 304_4, 304_5, 304_6, 304_7, 304_8, 304_9, 304_11, 304_12, 304_13, 304_14, 304_15, 305_1, 306_1, 307_1, 308_1, 309_1, 310_1, 311_1, 312_1, 313_1, 314_1, 315_1, 316_1, 317_1, 318_1, 319_1, 320_1, 321_1, 322_1, 323_1, 324_1, 325_1, 326_1, 327_1, 328_1, 329_1, 330_1, 331_1, 332_1, 333_1, 334_1, 335_1, 336_1, 337_1, 338_1, 339_1, 340_1, 341_1, 342_1, 343_1, 344_1, 345_1, 346_1, 347_1, 348_1, 349_1, 350_1, 351_1, 352_1, 353_1, 354_1, 355_1, 356_1, 357_1, 358_1, 359_1, 360_1, 361_1, 361_10, 361_2, 361_3, 361_4, 361_5, 361_6, 361_7, 361_8, 361_9, 362_1, 362_10, 362_2, 362_3, 362_4, 362_5, 362_6, 362_7, 362_8, 362_9, 363_1, 364_1, 365_1, 366_1, 367_1, 368_1, 369_1, 370_1, 371_1, 372_1, 373_1, 374_1, 375_1, 376_1, 377_1, 378_1, 379_1, 380_1, 381_1, 382_1, 383_1, 384_1, 385_1, 386_1, 387_1, 388_1, 389_1, 390_1, 391_1, 392_1, 393_1, 394_1, 395_1, 396_1, 397_1, 398_1, 399_1, 400_1, 401_1, 402_1, 403_1, 404_1, 405_1, 406_1, 407_1, 408_1, 409_1, 410_1, 411_1, 412_1, 413_1, 414_1, 415_1, 416_1, 417_1, 418_1, 419_1, 420_1, 421_1, 422_1, 423_1, 424_1, 425_1, 425_10, 425_2, 425_3, 425_4, 425_5, 425_6, 425_7, 425_8, 425_9, 426_1, 427_1, 428_1, 429_1, 430_1, 431_1, 432_1, 433_1, 434_1, 435_1, 436_1, 437_1, 438_1, 439_1, 440_1, 441_1, 442_1, 443_1, 444_1, 445_1, 446_1, 447_1, 448_1, 449_1, 450_1, 451_1, 452_1, 453_1, 454_1, 455_1, 456_1, 457_1, 458_1, 459_1, 460_1, 461_1, 462_1, 463_1, 464_1, 465_1, 466_1, 467_1, 468_1, 469_1, 470_1, 471_1, 472_1, 473_1, 474_1, 475_1, 476_1, 477_1, 478_1, 479_1, 480_1, 481_1, 482_1, 483_1, 484_1, 485_1, 486_1, 487_1, 488_1, 489_1, 490_1, 491_1, 492_1, 493_1, 494_1, 495_1, 496_1, 497_1, 498_1, 499_1, 500_1, 501_1, 502_1, 503_1, 504_1, 505_1, 506_1, 507_1, 508_1, 509_1, 510_1, 511_1, 512_1, 513_1, 514_1, 515_1, 516_1, 517_1, 518_1, 519_1, 520_1, 521_1, 522_1, 523_1, 524_1, 525_1, 526_1, 527_1, 528_1, 529_1, 530_1, 531_1, 532_1, 533_1, 534_1, 535_1, 536_1, 537_1, 538_1, 539_1, 540_1, 541_1, 542_1, 543_1, 544_1, 545_1, 546_1, 547_1, 548_1, 549_1, 550_1, 551_1, 552_1, 553_1, 554_1, 555_1, 556_1, 557_1, 558_1, 559_1, 560_1, 561_1, 562_1, 563_1, 564_1, 565_1, 566_1, 567_1, 568_1, 569_1, 570_1, 570_2, 570_3, 570_4, 570_5, 570_6, 570_7, 570_8, 570_9, 570_10, 570_11, 570_12, 570_13, 570_14, 571_1, 571_2, 571_3, 571_4, 571_5, 571_6, 571_7, 571_8, 571_9, 571_10, 571_11, 571_12, 571_13, 571_14, 572_1, 572_2, 572_3, 572_4, 572_5, 572_6, 572_7, 572_8, 572_9, 572_10, 572_11, 572_12, 572_13, 572_14, 573_1, 573_2, 573_3, 573_4, 573_5, 573_6, 573_7, 573_8, 573_9, 573_10, 573_11, 573_12, 573_13, 573_14, 574_1, 574_2, 574_3, 574_4, 574_5, 574_6, 574_7, 574_8, 574_9, 574_10, 574_11, 574_12, 574_13, 574_14, 575_1, 575_2, 575_3, 575_4, 575_5, 575_6, 575_7, 575_8, 575_9, 575_10, 575_11, 575_12, 575_13, 575_14, 576_1, 576_2, 576_3, 576_4, 576_5, 576_6, 576_7, 576_8, 576_9, 576_10, 576_11, 576_12, 576_13, 576_14, 577_1, 577_2, 577_3, 577_4, 577_5, 577_6, 577_7, 577_8, 577_9, 577_10, 577_11, 577_12, 577_13, 577_14, 578_1, 578_2, 578_3, 578_4, 578_5, 578_6, 578_7, 578_8, 578_9, 579_1, 579_2, 579_3, 579_4, 579_5, 579_6, 579_7, 579_8, 579_9, 580_1, 580_2, 580_3, 580_4, 580_5, 580_6, 580_7, 580_8, 580_9, 581_1, 581_2, 581_3, 581_4, 581_5, 581_6, 581_7, 581_8, 581_9, 582_1, 582_2, 582_3, 582_4, 582_5, 582_6, 582_7, 582_8, 582_9, 583_1, 583_2, 583_3, 583_4, 583_5, 583_6, 583_7, 583_8, 583_9, 584_1, 584_2, 584_3, 584_4, 584_5, 584_6, 584_7, 584_8, 585_1, 585_2, 585_3, 585_4, 585_5, 585_6, 585_7, 585_8, 585_9, 585_10, 585_11, 585_12, 585_13, 585_14, 586_1, 586_2, 586_3, 586_4, 586_5, 586_6, 586_7, 586_8, 586_9, 586_10, 586_11, 586_12, 586_13, 586_14, 587_1, 587_2, 587_3, 587_4, 587_5, 587_6, 587_7, 587_8, 587_9, 587_10, 587_11, 587_12, 587_13, 587_14, 588_1, 588_2, 588_3, 588_4, 588_5, 588_6, 588_7, 588_8, 588_9, 588_10, 588_11, 588_12, 588_13, 588_14, 589_1, 589_2, 589_3, 589_4, 589_5, 589_6, 589_7, 589_8, 589_9, 589_10, 589_11, 589_12, 589_13, 589_14, 590_1, 590_10, 590_11, 590_12, 590_13, 590_14, 590_15, 590_2, 590_3, 590_4, 590_5, 590_6, 590_7, 590_8, 590_9, 590_16, 590_17, 590_18, 590_19, 590_20, 591_1, 591_2, 592_1, 592_2, 592_3, 592_4, 592_5, 592_6, 592_7, 592_8, 592_9, 592_10, 592_11, 592_12, 592_13, 592_14, 593_1, 593_2, 593_3, 593_4, 594_1, 594_2, 594_3, 594_4, 595_1, 595_2, 595_3, 595_4, 596_1, 596_2, 596_3, 596_4, 597_1, 597_2, 597_3, 597_4, 598_1, 598_2, 598_3, 598_4, 599_1, 599_2, 599_3, 599_4, 600_1, 600_2, 600_3, 600_4, 601_1, 601_2, 601_3, 601_4, 602_1, 602_2, 602_3, 602_4, 603_1, 603_2, 603_3, 603_4, 604_1, 604_2, 604_3, 604_4, 605_1, 605_2, 605_3, 605_4, 606_1, 606_2, 606_3, 606_4, 607_1, 607_2, 607_3, 607_4, 608_1, 608_2, 608_3, 608_4, 608_5, 608_6, 608_7, 608_8, 608_9, 609_1, 609_2, 609_3, 609_4, 609_5, 609_6, 609_7, 609_8, 609_9, 610_1, 610_2, 610_3, 610_4, 610_5, 610_6, 610_7, 610_8, 610_9, 611_1, 611_2, 611_3, 611_4, 611_5, 611_6, 611_7, 611_8, 611_9, 612_1, 612_2, 612_3, 612_4, 612_5, 612_6, 612_7, 612_8, 612_9, 613_1, 613_2, 613_3, 613_4, 613_5, 613_6, 613_7, 613_8, 613_9, 613_10, 614_1, 614_2, 614_3, 614_4, 614_5, 614_6, 614_7, 614_8, 614_9, 614_10, 615_1, 615_2, 615_3, 615_4, 615_5, 615_6, 615_7, 615_8, 615_9, 615_10, 616_1, 616_2, 616_3, 616_4, 616_5, 616_6, 616_7, 616_8, 616_9, 616_10, 617_1, 617_2, 617_3, 617_4, 617_5, 617_6, 617_7, 617_8, 617_9, 617_10, 618_1, 618_2, 618_3, 618_4, 618_5, 618_6, 618_7, 618_8, 618_9, 618_10, 619_1, 619_2, 619_3, 619_4, 619_5, 619_6, 619_7, 619_8, 619_9, 619_10, 620_1, 620_2, 620_3, 620_4, 620_5, 620_6, 620_7, 620_8, 620_9, 620_10, 621_1, 621_2, 621_3, 621_4, 621_5, 621_6, 621_7, 621_8, 621_9, 621_10, 621_11, 622_1, 622_2, 622_3, 622_4, 622_5, 622_6, 622_7, 622_8, 622_9, 622_10, 623_1, 623_2, 623_3, 623_4, 623_5, 623_6, 623_7, 623_8, 623_9, 623_10, 624_1, 624_2, 624_3, 624_4, 624_5, 624_6, 624_7, 624_8, 624_9, 624_10, 625_1, 625_2, 625_3, 625_4, 625_5, 625_6, 625_7, 625_8, 625_9, 625_10, 625_11, 625_12, 625_13, 625_14, 626_1, 626_2, 626_3, 626_4, 626_5, 626_6, 626_7, 626_8, 626_9, 626_10, 626_11, 626_12, 626_13, 626_14, 627_1, 627_2, 627_3, 627_4, 627_5, 627_6, 627_7, 627_8, 627_9, 627_10, 627_11, 627_12, 627_13, 627_14, 628_1, 628_2, 628_3, 628_4, 628_5, 628_6, 628_7, 628_8, 628_9, 628_10, 628_11, 628_12, 628_13, 628_14, 629_1, 629_10, 629_11, 629_2, 629_3, 629_4, 629_5, 629_6, 629_7, 629_8, 629_9, 629_12, 629_13, 629_14, 629_15, 629_16, 630_1, 630_2, 630_3, 631_1, 631_10, 631_2, 631_3, 631_4, 631_5, 631_6, 631_7, 631_8, 631_9, 631_11, 631_12, 631_13, 631_14, 631_15, 632_1, 632_2, 632_3, 632_4, 632_5, 632_6, 632_7, 632_8, 632_9, 632_10, 632_11, 632_12, 632_13, 632_14, 633_1, 633_2, 633_3, 633_4, 633_5, 633_6, 633_7, 633_8, 633_9, 634_1, 634_2, 634_3, 634_4, 634_5, 634_6, 634_7, 634_8, 634_9, 635_1, 635_2, 635_3, 635_4, 635_5, 635_6, 635_7, 635_8, 635_9, 636_1, 636_2, 636_3, 636_4, 636_5, 636_6, 636_7, 636_8, 636_9, 637_1, 637_2, 637_3, 637_4, 637_5, 637_6, 637_7, 637_8, 637_9, 638_1, 638_2, 638_3, 638_4, 638_5, 638_6, 638_7, 638_8, 638_9, 638_10, 638_11, 638_12, 638_13, 638_14, 639_1, 639_2, 639_3, 639_4, 639_5, 639_6, 639_7, 639_8, 639_9, 639_10, 639_11, 639_12, 639_13, 639_14, 640_1, 640_2, 640_3, 640_4, 640_5, 640_6, 640_7, 640_8, 640_9, 640_10, 640_11, 640_12, 640_13, 640_14, 641_1, 641_2, 641_3, 641_4, 641_5, 641_6, 641_7, 641_8, 641_9, 642_1, 642_10, 642_11, 642_12, 642_13, 642_14, 642_15, 642_16, 642_17, 642_2, 642_3, 642_4, 642_5, 642_6, 642_7, 642_8, 642_9, 642_18, 642_19, 642_20, 642_21, 642_22, 643_1, 644_1, 644_2, 644_3, 644_4, 644_5, 644_6, 645_1, 645_2, 645_3, 645_4, 645_5, 645_6, 645_7, 645_8, 645_9, 645_10, 646_1, 646_10, 646_11, 646_12, 646_13, 646_14, 646_15, 646_16, 646_17, 646_18, 646_19, 646_2, 646_3, 646_4, 646_5, 646_6, 646_7, 646_8, 646_9, 646_20, 646_21, 646_22, 646_23, 646_24, 647_1, 648_1, 649_1, 650_1, 651_1, 652_1, 653_1, 654_1, 655_1, 656_1, 657_1, 658_1, 659_1, 660_1, 661_1, 662_1, 663_1, 664_1, 665_1, 666_1, 667_1, 668_1, 669_1, 670_1, 671_1, 672_1, 673_1, 674_1, 675_1, 676_1, 677_1, 678_1, 679_1, 679_2, 679_3, 679_4, 679_5, 680_1, 680_2, 680_3, 680_4, 680_5, 681_1, 681_2, 681_3, 681_4, 681_5, 682_1, 682_2, 682_3, 682_4, 682_5, 683_1, 683_2, 683_3, 683_4, 683_5, 684_1, 684_2, 684_3, 684_4, 684_5, 685_1, 685_2, 685_3, 685_4, 685_5, 686_1, 686_2, 686_3, 686_4, 686_5, 687_1, 687_2, 687_3, 687_4, 687_5, 688_1, 688_2, 688_3, 688_4, 688_5, 689_1, 689_2, 689_3, 689_4, 689_5, 690_1, 690_2, 690_3, 690_4, 690_5, 691_1, 691_2, 692_1, 692_2, 692_3, 692_4, 692_5, 693_1, 693_2, 693_3, 693_4, 693_5, 694_1, 694_2, 694_3, 694_4, 694_5, 695_1, 695_2, 695_3, 695_4, 695_5, 696_1, 696_2, 696_3, 696_4, 696_5, 697_1, 697_2, 697_3, 697_4, 697_5, 698_1, 698_2, 698_3, 698_4, 698_5, 699_1, 699_2, 699_3, 699_4, 699_5, 700_1, 700_2, 700_3, 700_4, 700_5, 701_1, 701_2, 701_3, 701_4, 701_5, 702_1, 702_2, 702_3, 702_4, 702_5, 703_1, 703_2, 703_3, 703_4, 703_5, 704_1, 704_2, 704_3, 704_4, 704_5, 705_1, 705_2, 705_3, 705_4, 705_5, 706_1, 706_2, 706_3, 706_4, 706_5, 707_1, 707_2, 707_3, 707_4, 707_5, 708_1, 708_2, 708_3, 708_4, 708_5, 709_1, 709_2, 709_3, 709_4, 709_5, 710_1, 710_2, 710_3, 710_4, 710_5, 711_1, 711_2, 711_3, 711_4, 711_5, 712_1, 712_2, 712_3, 712_4, 712_5, 713_1, 713_2, 713_3, 713_4, 713_5, 714_1, 714_2, 714_3, 714_4, 714_5, 715_1, 715_2, 715_3, 715_4, 715_5, 716_1, 716_2, 716_3, 716_4, 716_5, 717_1, 717_2, 717_3, 717_4, 717_5, 718_1, 718_2, 719_1, 719_2, 719_3, 719_4, 719_5, 720_1, 720_2, 720_3, 720_4, 720_5, 721_1, 721_2, 721_3, 721_4, 721_5, 722_1, 722_2, 722_3, 722_4, 722_5, 723_1, 723_2, 723_3, 723_4, 723_5, 724_1, 724_2, 724_3, 724_4, 724_5, 725_1, 725_2, 725_3, 725_4, 725_5, 726_1, 726_2, 726_3, 726_4, 726_5, 727_1, 727_2, 727_3, 727_4, 727_5, 728_1, 728_2, 728_3, 728_4, 728_5, 729_1, 729_2, 729_3, 729_4, 729_5, 730_1, 730_2, 730_3, 730_4, 730_5, 731_1, 731_2, 731_3, 731_4, 731_5, 732_1, 732_2, 732_3, 732_4, 732_5, 733_1, 733_2, 733_3, 733_4, 733_5, 734_1, 734_2, 734_3, 734_4, 734_5, 735_1, 735_2, 735_3, 735_4, 735_5, 736_1, 736_2, 736_3, 736_4, 736_5, 737_1, 737_2, 737_3, 737_4, 737_5, 738_1, 738_2, 738_3, 738_4, 738_5, 738_6, 739_1, 739_2, 739_3, 739_4, 739_5, 740_1, 740_2, 740_3, 740_4, 740_5, 741_1, 741_2, 741_3, 741_4, 741_5, 742_1, 742_2, 742_3, 743_1, 743_2, 743_3, 743_4, 743_5, 744_1, 744_2, 744_3, 744_4, 744_5, 745_1, 745_2, 745_3, 745_4, 745_5, 746_1, 746_2, 746_3, 747_1, 747_2, 747_3, 747_4, 747_5, 748_1, 748_2, 748_3, 748_4, 748_5, 749_1, 749_2, 749_3, 749_4, 749_5, 750_1, 750_2, 750_3, 750_4, 751_1, 751_2, 751_3, 751_4, 751_5, 752_1, 752_2, 752_3, 752_4, 752_5, 753_1, 753_2, 753_3, 753_4, 753_5, 754_1, 754_2, 754_3, 754_4, 754_5, 755_1, 755_2, 755_3, 755_4, 755_5, 756_1, 756_2, 756_3, 756_4, 756_5, 757_1, 757_2, 757_3, 757_4, 757_5, 758_1, 758_2, 758_3, 758_4, 758_5, 759_1, 759_2, 759_3, 759_4, 759_5, 760_1, 760_2, 760_3, 760_4, 760_5, 761_1, 761_2, 761_3, 761_4, 761_5, 762_1, 762_2, 762_3, 762_4, 762_5, 763_1, 763_2, 763_3, 763_4, 763_5, 764_1, 764_2, 764_3, 764_4, 764_5, 765_1, 765_2, 765_3, 765_4, 765_5, 766_1, 766_2, 766_3, 766_4, 766_5, 767_1, 767_2, 767_3, 767_4, 767_5, 768_1, 768_2, 768_3, 768_4, 768_5, 769_1, 769_2, 769_3, 769_4, 769_5, 770_1, 770_2, 770_3, 770_4, 770_5, 771_1, 771_2, 771_3, 771_4, 771_5, 772_1, 772_2, 772_3, 772_4, 772_5, 773_1, 773_2, 773_3, 773_4, 773_5, 774_1, 774_2, 774_3, 774_4, 774_5, 775_1, 775_2, 775_3, 775_4, 775_5, 776_1, 776_2, 776_3, 776_4, 776_5, 777_1, 777_2, 777_3, 777_4, 777_5, 778_1, 778_2, 778_3, 778_4, 778_5, 779_1, 779_2, 779_3, 779_4, 779_5, 780_1, 780_2, 780_3, 780_4, 780_5, 781_1, 782_1, 782_2, 782_3, 782_4, 782_5, 783_1, 783_2, 783_3, 783_4, 783_5, 784_1, 784_2, 784_3, 784_4, 784_5, 785_1, 786_1, 786_2, 786_3, 786_4, 786_5, 787_1, 787_2, 787_3, 787_4, 787_5, 788_1, 788_2, 788_3, 788_4, 788_5, 789_1, 789_2, 789_3, 789_4, 789_5, 790_1, 790_2, 790_3, 790_4, 790_5, 791_1, 791_2, 791_3, 791_4, 791_5, 792_1, 792_2, 792_3, 792_4, 792_5, 793_1, 793_2, 793_3, 793_4, 793_5, 794_1, 794_2, 794_3, 794_4, 794_5, 795_1, 795_2, 795_3, 795_4, 795_5, 796_1, 796_2, 796_3, 796_4, 796_5, 797_1, 797_2, 797_3, 797_4, 797_5, 798_1, 798_2, 798_3, 798_4, 798_5, 799_1, 799_2, 799_3, 799_4, 799_5, 800_1, 800_2, 800_3, 800_4, 800_5, 801_1, 801_2, 801_3, 801_4, 801_5, 802_1, 802_2, 802_3, 802_4, 802_5, 803_1, 803_2, 803_3, 803_4, 803_5, 804_1, 804_2, 804_3, 804_4, 804_5, 805_1, 805_2, 805_3, 805_4, 805_5, 806_1, 806_2, 806_3, 806_4, 806_5, 807_1, 807_2, 807_3, 807_4, 807_5, 808_1, 808_2, 808_3, 808_4, 808_5, 809_1, 809_2, 809_3, 809_4, 809_5, 810_1, 810_2, 810_3, 810_4, 810_5, 811_1, 811_2, 811_3, 811_4, 811_5, 812_1, 812_2, 812_3, 812_4, 812_5, 813_1, 813_2, 813_3, 813_4, 813_5, 814_1, 814_2, 814_3, 814_4, 814_5, 815_1, 815_2, 815_3, 815_4, 815_5, 816_1, 816_2, 816_3, 816_4, 816_5, 816_6, 817_1 and 818_1.

86. The oligonucleotide of embodiment 85, wherein the oligonucleotide is selected from CMP-ID-NO: 155_1 or 165_1.

87. The oligonucleotide of embodiment 85, wherein the oligonucleotide is selected from the group consisting of CMP-ID-NO 169_52, 169_50 or 169_56.

88. The oligonucleotide of embodiment 85, wherein the oligonucleotide is selected from the group consisting of CMP-ID-NO: 172_1, 272_1, 572_7, 572_6 or 572_5.

89. The oligonucleotide of embodiment 85, wherein the oligonucleotide is selected from CMP-ID-NO: 175_1.

90. The oligonucleotide of embodiment 85, wherein the oligonucleotide is selected from CMP-ID-NO: 178_1.

91. The oligonucleotide of embodiment 85, wherein the oligonucleotide is selected from CMP-ID-NO: 573_8, 186_1 or 187_1.

92. The oligonucleotide of embodiment 85, wherein the oligonucleotide is selected from CMP-ID-NO: 186_1.

93. The oligonucleotide of embodiment 85, wherein the oligonucleotide is selected from the group consisting of CMP-ID-NO: 200_1, 204_1, 206_1, 35_2 or 209_1.

94. The oligonucleotide of embodiment 85, wherein the oligonucleotide is selected from the group consisting of CMP-ID-NO: 585_1, 585_8, 586_9, 586_5, 586_8, 586_4 or 586_6.

95. The oligonucleotide of embodiment 85, wherein the oligonucleotide is selected from CMP-ID-NO: 233_1.

96. The oligonucleotide of embodiment 85, wherein the oligonucleotide is selected from CMP-ID-NO: 237_8 or 590_13.

97. The oligonucleotide of embodiment 85, wherein the oligonucleotide is selected from CMP-ID-NO: 220_1.

98. The oligonucleotide of embodiment 85, wherein the oligonucleotide is selected from the group consisting of CMP-ID-NO: 591_1, 592_2, 592_4 or 241_9.

99. The oligonucleotide of embodiment 85, wherein the oligonucleotide is selected from the group consisting of CMP-ID-NO: 597_4, 598_4, 39_1 or 602_1.

100. The oligonucleotide of embodiment 85, wherein the oligonucleotide is selected from CMP-ID-NO: 39_1.

101. The oligonucleotide of embodiment 85, wherein the oligonucleotide is selected from CMP-ID-NO: 611_7.

102. The oligonucleotide of embodiment 85, wherein the oligonucleotide is selected from the group consisting of CMP-ID-NO: 271_1 or 278_1.

103. The oligonucleotide of embodiment 85, wherein the oligonucleotide is selected from the group consisting of CMP-ID-NO: 616_4, 621_2, 621_1, 622_3, 622_5, 622_4, 624_3, 624_5, 287_1, 625_6, 626_7, 626_8, 626_9, 48_1, 631_6, 631_1, 303_1, 304_6 or 304_10.

104. The oligonucleotide of embodiment 85, wherein the oligonucleotide is selected from CMP-ID-NO: 636_8.

105. The oligonucleotide of embodiment 85, wherein the oligonucleotide is selected from the group consisting of CMP-ID-NO: 638_8, 639_5, 331_1 or 640_4.

106. The oligonucleotide of embodiment 85, wherein the oligonucleotide is selected from the group consisting of CMP-ID-NO: 359_1, 361_1, 361_5, 362_1 or 641_5.

107. The oligonucleotide of embodiment 85, wherein the oligonucleotide is selected from the group consisting of CMP-ID-NO: 378_1, 379_1 or 399_1.

108. The oligonucleotide of embodiment 85, wherein the oligonucleotide is selected from the group consisting of CMP-ID-NO: 403_1, 405_1, 642_12, 642_13, 644_3 or 646_16.

109. The oligonucleotide of embodiment 85, wherein the oligonucleotide is selected from CMP-ID-NO: 85_1 or 425_5.

110. The oligonucleotide of embodiment 85, wherein the oligonucleotide is selected from CMP-ID-NO: 116_1.

111. The oligonucleotide of embodiment 85, wherein the oligonucleotide is selected from CMP-ID-NO: 123_1 or 124_1.

112. The oligonucleotide of embodiment 85, wherein the oligonucleotide is selected from CMP-ID-NO: 126_2.

113. A conjugate comprising the oligonucleotide according to any one of embodiments 1-112, and at least one conjugate moiety covalently attached to said oligonucleotide.

114. The oligonucleotide conjugate of embodiment 113, wherein the conjugate moiety is selected from carbohydrates, cell surface receptor ligands, drug substances, hormones, lipophilic substances, polymers, proteins, peptides, toxins, vitamins, viral proteins or combinations thereof.

115. The oligonucleotide conjugate of embodiment 113 or 114, wherein the conjugate moiety is an antibody or antibody fragment.

116. The oligonucleotide conjugate of embodiment 115, wherein the antibody or antibody fragment has affinity to the transferrin receptor.

117. The oligonucleotide conjugate of embodiment 113-115, comprising a linker which is positioned between the oligonucleotide and the conjugate moiety.

118. The oligonucleotide conjugate of embodiment 117, wherein the linker is a physiologically labile linker.

119. The oligonucleotide conjugate of embodiment 118, wherein the physiologically labile linker is nuclease susceptible linker.

120. The oligonucleotide conjugate of embodiment 118 or 119, wherein the oligonucleotide has the formula D-F-G-F' or F-G-F'-D', wherein F, F' and G are as defined in embodiments 73-80 and D or D' comprises 1, 2 or 3 DNA nucleosides with phosphorothioate internucleoside linkages.

121. The oligonucleotide conjugate of embodiment 113-120, which display improved uptake into the brain of the conjugate oligonucleotide as compared to an unconjugated oligonucleotide.

122. A pharmaceutical composition comprising the oligonucleotide of embodiment 1-112 or a conjugate of embodiment 113-121 and a pharmaceutically acceptable diluent, carrier, salt and/or adjuvant.

123. A method for manufacturing the oligonucleotide of embodiment 1-112, comprising reacting nucleotide units thereby forming covalently linked contiguous nucleotide units comprised in the oligonucleotide.

124. The method of embodiment 123, further comprising reacting the contiguous nucleotide sequence with a non-nucleotide conjugation moiety.

125. A method for manufacturing the composition of embodiment 122, comprising mixing the oligonucleotide with a pharmaceutically acceptable diluent, carrier, salt and/or adjuvant.

126. An in vivo or in vitro method for inducing UBE3A expression in a target cell where expression of paternal UBE3A is suppressed, said method comprising administering an oligonucleotide of any one of embodiments 1-112 or a conjugate of embodiment 113-121 or the pharmaceutical composition of embodiment 122 in an effective amount to said cell.

127. The method of embodiment 126, wherein the expression of UBE3A is increased by at least 40% compared to a control.

128. The method of embodiment 126 or 127, wherein the level of the SNHG14 transcript downstream of SNORD109B is reduced by at least 30% compared to a control.

129. The method of embodiment 126-128, wherein the target cell is a neuronal cell.

130. The method of embodiment 126-129, wherein the expression of SNORD115 is not significantly affected compared to a control.

131. A method for treating or preventing a disease comprising administering a therapeutically or prophylactically effective amount of an oligonucleotide of embodiment 1-112 or a conjugate of embodiment 113-121 or the pharmaceutical composition of embodiment 122 to a subject suffering from or susceptible to the disease.

132. The oligonucleotide of embodiment 1-112 or a conjugate of embodiment 113-121 or the pharmaceutical composition of embodiment 122, for use as a medicament for treatment or prevention of a disease in a subject.

133. Use of the oligonucleotide of oligonucleotide of embodiment 1-112 or a conjugate of embodiment 113-121 for the preparation of a medicament for treatment or prevention of a disease in a subject.

134. The method, the oligonucleotide or the use of embodiments 131-133, wherein the disease is associated with in vivo activity of UBE3A.

135. The method, the oligonucleotide or the use of embodiments 131-134, wherein the disease is associated with reduced expression of UBE3A and/or reduced activity of UBE3A in neuronal cells.

136. The method, the oligonucleotide or the use of embodiment 135, wherein the reduced expression of UBE3A and/or reduced activity of UBE3A is due to mutations in the maternal allele of the UBE3A gene.

137. The method, the oligonucleotide or the use of embodiments 134-136, wherein the UBE3A expression is increased by at least 30%, or at least 50%, or at least 70%, or at least 90%, or at least 100%, or at least 150% or at least 200%, compared to the expression without the oligonucleotide of embodiment 1-112 or a conjugate of embodiment 113-121 or the pharmaceutical composition of embodiment 122.

138. The method, the oligonucleotide or the use of embodiments 131-137, wherein the disease is Angelman syndrome.

139. The method, the oligonucleotide or the use of embodiments 131-138, wherein the subject is a mammal.

140. The method, the oligonucleotide or the use of embodiment 139, wherein the mammal is human.

141. The method, the oligonucleotide or the use of embodiment 139 or 140, wherein the subject is an infant or a juvenile.

EXAMPLES

Materials and methods

TABLE 3

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 4 | AACTTCATCAATATTTCCC | 3-13-3 | AACttcatcaatatttCCC | 4_1 | −23.36 | 1677 |
| 4 | AACTTCATCAATATTTCCC | 2-15-2 | AActtcatcaatatttcCC | 4_2 | −19.60 | 1677 |
| 5 | ACTTCATCAATATTTCCC | 3-12-3 | ACTtcatcaatatttCCC | 5_1 | −23.80 | 1677 |
| 5 | ACTTCATCAATATTTCCC | 2-14-2 | ACttcatcaatatttcCC | 5_2 | −20.24 | 1677 |
| 6 | CAACTTCATCAATATTTCCC | 2-14-4 | CAacttcatcaatattTCCC | 6_1 | −25.64 | 1677 |
| 6 | CAACTTCATCAATATTTCCC | 2-16-2 | CAacttcatcaatatttcCC | 6_2 | −22.28 | 1677 |
| 7 | CAACTTCATCAATATTTCC | 4-13-2 | CAACttcatcaatatttCC | 7_1 | −21.47 | 1678 |
| 7 | CAACTTCATCAATATTTCC | 2-15-2 | CAacttcatcaatatttCC | 7_2 | −19.46 | 1678 |
| 8 | CCAACTTCATCAATATTTCC | 3-14-3 | CCAacttcatcaatattTCC | 8_1 | −25.64 | 1678 |
| 9 | CCCAACTTCATCAATATTTC | 4-14-2 | CCCAacttcatcaatattTC | 9_1 | −25.64 | 1679 |
| 10 | ACCCAACTTCATCAATATTT | 2-16-2 | ACccaacttcatcaatatTT | 10_1 | −20.05 | 1680 |
| 11 | CCCAACTTCATCAATATTT | 4-13-2 | CCCAacttcatcaatatTT | 11_1 | −23.96 | 1680 |
| 11 | CCCAACTTCATCAATATTT | 2-15-2 | CCcaacttcatcaatatTT | 11_2 | −20.28 | 1680 |
| 12 | ACCCAACTTCATCAATATT | 4-13-2 | ACCCaacttcatcaataTT | 12_1 | −23.64 | 1681 |
| 12 | ACCCAACTTCATCAATATT | 2-15-2 | ACccaacttcatcaataTT | 12_2 | −19.18 | 1681 |
| 13 | CCCAACTTCATCAATATT | 4-12-2 | CCCAacttcatcaataTT | 13_1 | −23.09 | 1681 |
| 13 | CCCAACTTCATCAATATT | 2-14-2 | CCcaacttcatcaataTT | 13_2 | −19.41 | 1681 |
| 14 | TACCCAACTTCATCAATAT | 2-15-2 | TAcccaacttcatcaatAT | 14_1 | −19.31 | 1682 |
| 15 | TACCCAACTTCATCAATA | 2-14-2 | TAcccaacttcatcaaTA | 15_1 | −19.14 | 1683 |
| 16 | TTACCCAACTTCATCAATA | 2-15-2 | TTacccaacttcatcaaTA | 16_1 | −19.74 | 1683 |
| 17 | TTTACCCAACTTCATCAAT | 4-13-2 | TTTAcccaacttcatcaAT | 17_1 | −21.68 | 1684 |
| 17 | TTTACCCAACTTCATCAAT | 2-15-2 | TTtacccaacttcatcaAT | 17_2 | −19.22 | 1684 |
| 18 | ATACTTTACCCAACTTCAT | 3-13-3 | ATActttacccaacttCAT | 18_1 | −23.44 | 1688 |
| 18 | ATACTTTACCCAACTTCAT | 2-15-2 | ATactttacccaacttcAT | 18_2 | −20.13 | 1688 |
| 19 | TACTTTACCCAACTTCAT | 3-12-3 | TACtttacccaacttCAT | 19_1 | −22.78 | 1688 |
| 19 | TACTTTACCCAACTTCAT | 2-14-2 | TActtttacccaacttcAT | 19_2 | −19.30 | 1688 |
| 20 | TTATACTTTACCCAACTTCA | 2-16-2 | TTtatactttacccaacttCA | 20_1 | −21.40 | 1689 |
| 21 | TCACTGTTCTGACTTT | 3-10-3 | TCActgttctgacTTT | 21_1 | −19.11 | 1712 |
| 22 | TTCAATCTCTATCTCATCAT | 2-16-2 | TTcaatctctatctcatcAT | 22_1 | −19.42 | 4169 |
| 23 | CTTCAATCTCTATCTCATCA | 4-14-2 | CTTCaatctctatctcatCA | 23_1 | −24.21 | 4170 |
| 23 | CTTCAATCTCTATCTCATCA | 2-16-2 | CTtcaatctctatctcatCA | 23_2 | −22.04 | 4170 |
| 24 | TTCAATCTCTATCTCATCA | 2-15-2 | TTcaatctctatctcatCA | 24_1 | −19.44 | 4170 |
| 25 | CTTCAATCTCTATCTCATC | 2-15-2 | CTtcaatctctatctcaTC | 25_1 | −19.87 | 4171 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 26 | ACTTCAATCTCTATCTCAT | 3-13-3 | ACTtcaatctctatctCAT | 26_1 | -22.36 | 4172 |
| 26 | ACTTCAATCTCTATCTCAT | 2-15-2 | ACttcaatctctatctcAT | 26_2 | -19.08 | 4172 |
| 27 | CACTTCAATCTCTATCTCAT | 2-16-2 | CActtcaatctctatctcAT | 27_1 | -20.98 | 4172 |
| 28 | ACTTCAATCTCTATCTCA | 2-12-4 | ACttcaatctctatCTCA | 28_1 | -21.96 | 4173 |
| 28 | ACTTCAATCTCTATCTCA | 2-14-2 | ACttcaatctctatctCA | 28_2 | -19.10 | 4173 |
| 29 | CACTTCAATCTCTATCTCA | 2-13-4 | CActtcaatctctatCTCA | 29_1 | -23.86 | 4173 |
| 29 | CACTTCAATCTCTATCTCA | 2-15-2 | CActtcaatctctatctCA | 29_2 | -21.00 | 4173 |
| 30 | ACACTTCAATCTCTATCTC | 2-15-2 | ACacttcaatctctatcTC | 30_1 | -19.38 | 4174 |
| 31 | TACACTTCAATCTCTATCTC | 2-14-4 | TAcacttcaatctctaTCTC | 31_1 | -23.31 | 4174 |
| 31 | TACACTTCAATCTCTATCTC | 2-16-2 | TAcacttcaatctctatcTC | 31_2 | -20.53 | 4174 |
| 32 | TACACTTCAATCTCTATCT | 4-13-2 | TACActtcaatctctatCT | 32_1 | -22.34 | 4175 |
| 33 | CTTTGTCTCTCTTTACT | 2-13-2 | CTttgtctctctttaCT | 33_1 | -19.36 | 4374 |
| 34 | TATACCTTTCTTTAACCC | 3-12-3 | TATacctttctttaaCCC | 34_1 | -24.89 | 8118 |
| 34 | TATACCTTTCTTTAACCC | 2-14-2 | TAtacctttctttaacCC | 34_2 | -20.83 | 8118 |
| 34 | TATACCTTTCTTTAACCC | 1-3-1-7-1-1-1-2 | TataCctttcttTaAcCC | 34_3 | -21.63 | 8116 |
| 34 | TATACCTTTCTTTAACCC | 1-4-1-6-1-3-2 | TatacCtttcttTaacCC | 34_4 | -21.31 | 8116 |
| 34 | TATACCTTTCTTTAACCC | 1-2-1-1-1-7-2-1-2 | TatAcCttctttAAcCC | 34_5 | -21.51 | 8116 |
| 34 | TATACCTTTCTTTAACCC | 2-3-1-7-1-2-2 | TataCctttctttAacCC | 34_6 | -21.84 | 8116 |
| 34 | TATACCTTTCTTTAACCC | 2-13-3 | TAtacctttctttaaCCC | 34_7 | -23.21 | 8116 |
| 35 | TGTTTATACCCTTTCC | 2-12-2 | TGtttatacccttCC | 35_1 | -20.33 | 9212 |
| 35 | TGTTTATACCCTTTCC | 4-10-2 | TGTTtatacccttCC | 35_2 | -22.69 | 9212 |
| 36 | TCTCCTTTATGACTCC | 2-10-4 | TCtcctttatgaCTCC | 36_1 | -23.29 | 10839 |
| 37 | CTTCTCCTTTATGACTC | 2-13-2 | CTtctcctttatgacTC | 37_1 | -19.26 | 10840 |
| 38 | CCATTTATTTCCATTTATT | 4-13-2 | CCATttatttccatttaTT | 38_1 | -22.32 | 15567 |
| 38 | CCATTTATTTCCATTTATT | 2-15-2 | CCatttatttccatttaTT | 38_2 | -19.61 | 15567 |
| 38 | CCATTTATTTCCATTTATT | 1-2-1-9-2-1-3 | CcaTttatttccaTTtATT | 38_3 | -20.02 | 15567 |
| 38 | CCATTTATTTCCATTTATT | 1-1-1-1-1-8-1-1-1-2 | CcAtTtatttccAtTtATT | 38_4 | -18.95 | 15567 |
| 38 | CCATTTATTTCCATTTATT | 2-2-1-8-1-3-2 | CCatTtatttccaTttaTT | 38_5 | -20.35 | 15567 |
| 38 | CCATTTATTTCCATTTATT | 1-2-3-6-1-3-3 | CcaTTTatttccAtttATT | 38_6 | -20.87 | 15567 |
| 39 | CTTTCCATTTATTTCCATTT | 2-14-4 | CTttccatttatttccATTT | 39_1 | -23.14 | 15570 |
| 39 | CTTTCCATTTATTTCCATTT | 1-13-1-1-1-1-2 | CtttccatttatttCcAtTT | 39_2 | -20.96 | 15570 |
| 39 | CTTTCCATTTATTTCCATTT | 1-13-1-3-2 | CtttccatttatttCcatTT | 39_3 | -20.91 | 15570 |
| 39 | CTTTCCATTTATTTCCATTT | 1-3-1-1-1-11-2 | CtttCcAtttatttccatTT | 39_4 | -20.96 | 15570 |
| 39 | CTTTCCATTTATTTCCATTT | 1-1-1-3-1-9-1-1-2 | CtTtccAtttatttccAtTT | 39_5 | -20.54 | 15570 |
| 40 | TCTTTCCATTTATTTCCATT | 2-14-4 | TCtttccatttatttcCATT | 40_1 | -24.62 | 15571 |
| 40 | TCTTTCCATTTATTTCCATT | 2-13-1-1-3 | TCtttccatttatttCcATT | 40_2 | -23.39 | 15571 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 40 | TCTTTCCATTTATTTCCATT | 2-13-1-2-2 | TCtttccatttatttCcaTT | 40_3 | −22.53 | 15571 |
| 40 | TCTTTCCATTTATTTCCATT | 2-14-1-1-2 | TCtttccatttatttcCaTT | 40_4 | −22.34 | 15571 |
| 40 | TCTTTCCATTTATTTCCATT | 2-3-1-11-3 | TCtttCcatttatttccATT | 40_5 | −23.39 | 15571 |
| 40 | TCTTTCCATTTATTTCCATT | 2-4-1-10-3 | TCtttcCatttatttccATT | 40_6 | −23.20 | 15571 |
| 40 | TCTTTCCATTTATTTCCATT | 2-3-1-12-2 | TCtttCcatttatttccaTT | 40_7 | −22.53 | 15571 |
| 40 | TCTTTCCATTTATTTCCATT | 2-4-1-11-2 | TCtttcCatttatttccaTT | 40_8 | −22.34 | 15571 |
| 41 | ATTACCCATCCGTTCT | 2-12-2 | ATtacccatccgttCT | 41_1 | −21.15 | 21965 |
| 42 | GCATTAGGCACATTACAT | 3-12-3 | GCAttaggcacattaCAT | 42_1 | −23.96 | 22211 |
| 43 | ATTATTATTTAACCTTCCTA | 2-16-2 | ATtattatttaaccttccTA | 43_1 | −19.28 | 30451 |
| 44 | ACATTATTATTTAACCTTCC | 4-14-2 | ACATtattatttaaccttCC | 44_1 | −22.84 | 30453 |
| 44 | ACATTATTATTTAACCTTCC | 2-16-2 | ACattattatttaaccttCC | 44_2 | −20.13 | 30453 |
| 45 | CATTATTATTTAACCTTCC | 4-13-2 | CATtattatttaaccttCC | 45_1 | −22.04 | 30453 |
| 45 | CATTATTATTTAACCTTCC | 2-15-2 | CAttattatttaaccttCC | 45_2 | −19.55 | 30453 |
| 46 | CCTCTGCTTATAACTTT | 2-13-2 | CCtctgcttataactTT | 46_1 | −19.15 | 30699 |
| 47 | CTACTATACTTTCCTCT | 2-11-4 | CTactatactttcCTCT | 47_1 | −22.32 | 30711 |
| 48 | GTTCTACTATACTTTCC | 4-11-2 | GTTCtactatactttCC | 48_1 | −21.69 | 30714 |
| 48 | GTTCTACTATACTTTCC | 2-13-2 | GTtctactatactttCC | 48_2 | −19.21 | 30714 |
| 48 | GTTCTACTATACTTTCC | 1-2-1-7-2-2-2 | GttCtactataCTttCC | 48_3 | −20.83 | 30712 |
| 48 | GTTCTACTATACTTTCC | 2-9-1-3-2 | GTtctactataCttttCC | 48_4 | −20.20 | 30712 |
| 48 | GTTCTACTATACTTTCC | 1-2-1-9-1-1-2 | GttCtactatactTtCC | 48_5 | −18.95 | 30712 |
| 48 | GTTCTACTATACTTTCC | 2-1-1-10-3 | GTtCtactatactttTCC | 48_6 | −21.18 | 30712 |
| 48 | GTTCTACTATACTTTCC | 1-3-1-10-2 | GttcTactatactttCC | 48_7 | −18.61 | 30712 |
| 49 | CACCTGATAACAGACCCT | 3-12-3 | CACctgataacagacCCT | 49_1 | −26.38 | 36068 |
| 50 | CACCTGATAACAGACC | 3-10-3 | CACctgataacagACC | 50_1 | −21.10 | 36070 |
| 51 | CCCACCAAAGGATATATT | 3-12-3 | CCCaccaaaggatatATT | 51_1 | −23.47 | 37208 |
| 52 | ACCAGCTACAGGAACCTC | 3-12-3 | ACCagctacaggaacCTC | 52_1 | −26.57 | 46132 |
| 53 | CTATATCTCACTCCTATTT | 4-13-2 | CTATatctcactcctatTT | 53_1 | −23.07 | 48143 |
| 53 | CTATATCTCACTCCTATTT | 2-13-4 | CTatatctcactcctATTT | 53_2 | −22.12 | 48143 |
| 54 | CTATATCTCACTCCTATT | 2-14-2 | CTatatctcactcctaTT | 54_1 | −19.40 | 48144 |
| 54 | CTATATCTCACTCCTATT | 2-12-4 | CTatatctcactccTATT | 54_2 | −22.28 | 48144 |
| 54 | CTATATCTCACTCCTATT | 3-12-3 | CTAtatctcactcctATT | 54_3 | −21.44 | 48144 |
| 55 | CTACTATATCTCACTCCTAT | 2-16-2 | CTactatatctcactcctAT | 55_1 | −22.00 | 48145 |
| 55 | CTACTATATCTCACTCCTAT | 2-14-4 | CTactatatctcactcCTAT | 55_2 | −25.54 | 48145 |
| 56 | TACTATATCTCACTCCTAT | 2-13-4 | TActatatctcactcCTAT | 56_1 | −23.29 | 48145 |
| 57 | CTACTATATCTCACTCCTA | 2-15-2 | CTactatatctcactccTA | 57_1 | −21.91 | 48146 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 58 | TACTATATCTCACTCCTA | 2-14-2 | TActatatctcactccTA | 58_1 | -19.66 | 48146 |
| 58 | TACTATATCTCACTCCTA | 2-12-4 | TActatatctcactCCTA | 58_2 | -23.59 | 48146 |
| 58 | TACTATATCTCACTCCTA | 3-12-3 | TACtatatctcactcCTA | 58_3 | -22.62 | 48146 |
| 59 | CTACTATATCTCACTCCT | 2-14-2 | CTactatatctcactcCT | 59_1 | -21.25 | 48147 |
| 59 | CTACTATATCTCACTCCT | 4-12-2 | CTACtatatctcactcCT | 59_2 | -23.87 | 48147 |
| 60 | CTACTATATCTCACTCC | 2-13-2 | CTactatatctcactCC | 60_1 | -20.13 | 48148 |
| 60 | CTACTATATCTCACTCC | 2-11-4 | CTactatatctcaCTCC | 60_2 | -23.00 | 48148 |
| 60 | CTACTATATCTCACTCC | 3-11-3 | CTActatatctcacTCC | 60_3 | -22.56 | 48148 |
| 61 | CCTACTATATCTCACTC | 2-11-4 | CCtactatatctcACTC | 61_1 | -21.93 | 48149 |
| 62 | CTCCTACTATATCTCACTC | 4-13-2 | CTCCtactatatctcacTC | 62_1 | -25.69 | 48149 |
| 63 | TCCTACTATATCTCACTC | 3-12-3 | TCCtactatatctcaCTC | 63_1 | -23.88 | 48149 |
| 64 | CTCCTACTATATCTCACT | 4-12-2 | CTCCtactatatctcaCT | 64_1 | -24.87 | 48150 |
| 64 | CTCCTACTATATCTCACT | 3-12-3 | CTCctactatatctcACT | 64_2 | -22.93 | 48150 |
| 65 | TTTCCTCTCCTACTATATC | 2-15-2 | TTtcctctcctactataTC | 65_1 | -21.23 | 48155 |
| 66 | ATCCATATCCTTTCCT | 3-10-3 | ATCcatatcctttCCT | 66_1 | -24.02 | 48168 |
| 67 | CATCCATATCCTTTCCT | 4-11-2 | CATCcatatcctttcCT | 67_1 | -24.94 | 48168 |
| 68 | ATCATCCATATCCTTTCC | 4-12-2 | ATCAtccatatcctttCC | 68_1 | -25.69 | 48169 |
| 69 | CATCATCCATATCCTTTC | 4-12-2 | CATCatccatatccttTC | 69_1 | -23.32 | 48170 |
| 69 | CATCATCCATATCCTTTC | 2-14-2 | CAtcatccatatccttTC | 69_2 | -20.72 | 48170 |
| 69 | CATCATCCATATCCTTTC | 2-12-4 | CAtcatccatatccTTTC | 69_3 | -22.56 | 48170 |
| 70 | TACATCATCCATATCCTTTC | 2-16-2 | TAcatcatccatatctttTC | 70_1 | -22.45 | 48170 |
| 70 | TACATCATCCATATCCTTTC | 4-14-2 | TACAtcatccatatcctttTC | 70_2 | -25.00 | 48170 |
| 70 | TACATCATCCATATCCTTTC | 2-14-4 | TAcatcatccatatccTTTC | 70_3 | -24.29 | 48170 |
| 71 | ACATCATCCATATCCTTT | 3-12-3 | ACAtcatccatatccTTT | 71_1 | -22.11 | 48171 |
| 72 | CATCATCCATATCCTTT | 2-13-2 | CAtcatccatatcctTT | 72_1 | -19.04 | 48171 |
| 72 | CATCATCCATATCCTTT | 4-11-2 | CATCatccatatcctTT | 72_2 | -21.64 | 48171 |
| 73 | TACATCATCCATATCCTTT | 2-15-2 | TAcatcatccatatcctTT | 73_1 | -20.76 | 48171 |
| 73 | TACATCATCCATATCCTTT | 2-13-4 | TAcatcatccatatcCTTT | 73_2 | -23.36 | 48171 |
| 73 | TACATCATCCATATCCTTT | 3-13-3 | TACatcatccatatccTTT | 73_3 | -22.88 | 48171 |
| 74 | ATACATCATCCATATCCTT | 2-15-2 | ATacatcatccatatccTT | 74_1 | -20.80 | 48172 |
| 74 | ATACATCATCCATATCCTT | 4-13-2 | ATACatcatccatatccTT | 74_2 | -23.12 | 48172 |
| 75 | TACATCATCCATATCCTT | 2-14-2 | TAcatcatccatatccTT | 75_1 | -19.97 | 48172 |
| 75 | TACATCATCCATATCCTT | 4-12-2 | TACAtcatccatatccTT | 75_2 | -22.52 | 48172 |
| 76 | TATACATCATCCATATCCTT | 2-16-2 | TAtacatcatccatatccTT | 76_1 | -21.36 | 48172 |
| 77 | ATACATCATCCATATCCT | 3-12-3 | ATAcatcatccatatCCT | 77_1 | -24.15 | 48173 |
| 77 | ATACATCATCCATATCCT | 2-14-2 | ATacatcatccatatcCT | 77_2 | -20.55 | 48173 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 77 | ATACATCATCCATATCCT | 2-13-3 | ATacatcatccatatCCT | 77_3 | -22.92 | 48173 |
| 78 | ATATACATCATCCATATCCT | 2-16-2 | ATatacatcatccatatcCT | 78_1 | -22.04 | 48173 |
| 79 | TACATCATCCATATCCT | 2-11-4 | TAcatcatccataTCCT | 79_1 | -23.21 | 48173 |
| 79 | TACATCATCCATATCCT | 2-13-2 | TAcatcatccatatcCT | 79_2 | -19.71 | 48173 |
| 79 | TACATCATCCATATCCT | 4-11-2 | TACAtcatccatatcCT | 79_3 | -22.27 | 48173 |
| 80 | TATACATCATCCATATCCT | 2-15-2 | TAtacatcatccatatcCT | 80_1 | -21.11 | 48173 |
| 80 | TATACATCATCCATATCCT | 3-13-3 | TATacatcatccatatCCT | 80_2 | -25.15 | 48173 |
| 80 | TATACATCATCCATATCCT | 4-13-2 | TATAcatcatccatatcCT | 80_3 | -24.01 | 48173 |
| 81 | ATACATCATCCATATCC | 3-11-3 | ATAcatcatccataTCC | 81_1 | -21.79 | 48174 |
| 82 | ATATACATCATCCATATCC | 4-13-2 | ATATacatcatccatatCC | 82_1 | -23.73 | 48174 |
| 82 | ATATACATCATCCATATCC | 2-15-2 | ATatacatcatccatatCC | 82_2 | -20.93 | 48174 |
| 83 | TATACATCATCCATATCC | 2-14-2 | TAtacatcatccatatCC | 83_1 | -20.00 | 48174 |
| 83 | TATACATCATCCATATCC | 4-12-2 | TATAcatcatccatatCC | 83_2 | -22.90 | 48174 |
| 84 | TATATACATCATCCATATCC | 2-16-2 | TAtatacatcatccatatCC | 84_1 | -21.49 | 48174 |
| 84 | TATATACATCATCCATATCC | 4-14-2 | TATAtacatcatccatatCC | 84_2 | -24.29 | 48174 |
| 85 | GCTTCATATTTCTCCA | 2-12-2 | GCttcatatttctcCA | 85_1 | -20.44 | 49345 |
| 85 | GCTTCATATTTCTCCA | 2-11-3 | GCttcatatttctCCA | 85_2 | -22.81 | 49345 |
| 86 | CATCTTGTTCTTTACCT | 2-13-2 | CAtcttgttctttacCT | 86_1 | -19.67 | 49581 |
| 87 | TATATTCACCATTGCC | 2-10-4 | TAtattcaccatTGCC | 87_1 | -22.70 | 49724 |
| 88 | CCTTATATTCACCATTG | 2-13-2 | CCttatattcaccatTG | 88_1 | -19.44 | 49726 |
| 88 | CCTTATATTCACCATTG | 2-11-4 | CCttatattcaccATTG | 88_2 | -21.25 | 49726 |
| 89 | CCTCCTTATATTCACC | 4-10-2 | CCTCcttatattcaCC | 89_1 | -24.64 | 49730 |
| 90 | CCCTTCCTTTATTCAA | 3-10-3 | CCCttcctttattCAA | 90_1 | -23.86 | 50189 |
| 91 | CCTTACTGTTAAATCCT | 2-13-2 | CCttactgttaaatcCT | 91_1 | -19.81 | 50475 |
| 92 | CAGGCAGATAACCTCCAA | 3-12-3 | CAGgcagataacctcCAA | 92_1 | -25.31 | 52419 |
| 93 | CAGCAGGCAGATAACCTC | 3-12-3 | CAGcaggcagataacCTC | 93_1 | -25.88 | 52422 |
| 94 | CGAATCTTGACATACAGG | 3-12-3 | CGAatcttgacatacAGG | 94_1 | -21.47 | 53955 |
| 95 | CTCATACTTGCTTTAAT | 4-11-2 | CTCAtacttgctttaAT | 95_1 | -19.10 | 60821 |
| 95 | CTCATACTTGCTTTAAT | 2-13-2 | CTcatacttgctttaAT | 95_2 | -16.35 | 60821 |
| 96 | ACATCTCATACTTGCTT | 2-11-4 | ACatctcatacttGCTT | 96_1 | -21.31 | 60825 |
| 96 | ACATCTCATACTTGCTT | 2-13-2 | ACatctcatacttgcTT | 96_2 | -17.66 | 60825 |
| 96 | ACATCTCATACTTGCTT | 2-12-3 | ACatctcatacttgCTT | 96_3 | -19.52 | 60825 |
| 97 | ACATCTCATACTTGCT | 2-10-4 | ACatctcatactTGCT | 97_1 | -21.18 | 60826 |
| 97 | ACATCTCATACTTGCT | 2-12-2 | ACatctcatacttgCT | 97_2 | -17.70 | 60826 |
| 97 | ACATCTCATACTTGCT | 2-11-3 | ACatctcatacttGCT | 97_3 | -19.49 | 60826 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 97 | ACATCTCATACTTGCT | 4-10-2 | ACATctcatacttgCT | 97_4 | -20.48 | 60826 |
| 98 | TACATCTCATACTTGCT | 2-11-4 | TAcatctcatactTGCT | 98_1 | -22.33 | 60826 |
| 98 | TACATCTCATACTTGCT | 2-13-2 | TAcatctcatacttgCT | 98_2 | -18.85 | 60826 |
| 98 | TACATCTCATACTTGCT | 4-11-2 | TACAtctcatacttgCT | 98_3 | -21.40 | 60826 |
| 99 | CCTACATCTCATACTTGC | 3-12-3 | CCTacatctcatactTGC | 99_1 | -26.29 | 60827 |
| 99 | CCTACATCTCATACTTGC | 2-14-2 | CCtacatctcatacttGC | 99_2 | -22.98 | 60827 |
| 99 | CCTACATCTCATACTTGC | 2-13-3 | CCtacatctcatactTGC | 99_3 | -24.67 | 60827 |
| 99 | CCTACATCTCATACTTGC | 2-12-4 | CCtacatctcatacTTGC | 99_4 | -25.70 | 60827 |
| 100 | CTACATCTCATACTTGC | 3-11-3 | CTAcatctcatactTGC | 100_1 | -22.33 | 60827 |
| 100 | CTACATCTCATACTTGC | 2-13-2 | CTacatctcatacttGC | 100_2 | -19.41 | 60827 |
| 100 | CTACATCTCATACTTGC | 2-12-3 | CTacatctcatactTGC | 100_3 | -21.10 | 60827 |
| 101 | TACATCTCATACTTGC | 3-10-3 | TACatctcatactTGC | 101_1 | -19.94 | 60827 |
| 101 | TACATCTCATACTTGC | 2-12-2 | TAcatctcatacttGC | 101_2 | -17.15 | 60827 |
| 101 | TACATCTCATACTTGC | 2-11-3 | TAcatctcatactTGC | 101_3 | -18.85 | 60827 |
| 101 | TACATCTCATACTTGC | 4-10-2 | TACAtctcatacttGC | 101_4 | -19.71 | 60827 |
| 102 | CCTACATCTCATACTTG | 4-11-2 | CCTAcatctcatactTG | 102_1 | -22.52 | 60828 |
| 102 | CCTACATCTCATACTTG | 2-13-2 | CCtacatctcatactTG | 102_2 | -19.67 | 60828 |
| 102 | CCTACATCTCATACTTG | 3-12-2 | CCTacatctcatactTG | 102_3 | -21.29 | 60828 |
| 102 | CCTACATCTCATACTTG | 3-11-3 | CCTacatctcatacTTG | 102_4 | -22.31 | 60828 |
| 103 | ACCTACATCTCATACTT | 3-11-3 | ACCtacatctcataCTT | 103_1 | -21.93 | 60829 |
| 103 | ACCTACATCTCATACTT | 2-13-2 | ACctacatctcatacTT | 103_2 | -17.76 | 60829 |
| 103 | ACCTACATCTCATACTT | 2-11-4 | ACctacatctcatACTT | 103_3 | -20.03 | 60829 |
| 103 | ACCTACATCTCATACTT | 3-12-2 | ACCtacatctcatacTT | 103_4 | -20.26 | 60829 |
| 104 | CCTACATCTCATACTT | 3-10-3 | CCTacatctcataCTT | 104_1 | -21.50 | 60829 |
| 104 | CCTACATCTCATACTT | 2-12-2 | CCtacatctcatacTT | 104_2 | -18.21 | 60829 |
| 104 | CCTACATCTCATACTT | 2-10-4 | CCtacatctcatACTT | 104_3 | -20.48 | 60829 |
| 105 | TACCTACATCTCATACTT | 4-12-2 | TACCtacatctcatacTT | 105_1 | -22.49 | 60829 |
| 105 | TACCTACATCTCATACTT | 2-14-2 | TAcctacatctcatacTT | 105_2 | -18.81 | 60829 |
| 105 | TACCTACATCTCATACTT | 2-13-3 | TAcctacatctcataCTT | 105_3 | -20.48 | 60829 |
| 105 | TACCTACATCTCATACTT | 2-12-4 | TAcctacatctcatACTT | 105_4 | -21.08 | 60829 |
| 106 | TTACCTACATCTCATACTT | 3-13-3 | TTAcctacatctcataCTT | 106_1 | -22.30 | 60829 |
| 106 | TTACCTACATCTCATACTT | 2-15-2 | TTacctacatctcatacTT | 106_2 | -19.40 | 60829 |
| 106 | TTACCTACATCTCATACTT | 2-14-3 | TTacctacatctcataCTT | 106_3 | -21.08 | 60829 |
| 106 | TTACCTACATCTCATACTT | 2-13-4 | TTacctacatctcatACTT | 106_4 | -21.67 | 60829 |
| 107 | ACCTACATCTCATACT | 4-10-2 | ACCTacatctcataCT | 107_1 | -21.72 | 60830 |
| 107 | ACCTACATCTCATACT | 2-12-2 | ACctacatctcataCT | 107_2 | -17.61 | 60830 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 107 | ACCTACATCTCATACT | 3-11-2 | ACCtacatctcataCT | 107_3 | -20.10 | 60830 |
| 107 | ACCTACATCTCATACT | 2-10-4 | ACctacatctcaTACT | 107_4 | -20.11 | 60830 |
| 108 | TACCTACATCTCATACT | 4-11-2 | TACCtacatctcataCT | 108_1 | -22.34 | 60830 |
| 108 | TACCTACATCTCATACT | 2-13-2 | TAcctacatctcataCT | 108_2 | -18.66 | 60830 |
| 108 | TACCTACATCTCATACT | 3-12-2 | TACctacatctcataCT | 108_3 | -19.85 | 60830 |
| 108 | TACCTACATCTCATACT | 3-11-3 | TACctacatctcatACT | 108_4 | -20.44 | 60830 |
| 109 | TTACCTACATCTCATACT | 2-12-4 | TTacctacatctcaTACT | 109_1 | -21.75 | 60830 |
| 109 | TTACCTACATCTCATACT | 2-14-2 | TTacctacatctcataCT | 109_2 | -19.25 | 60830 |
| 109 | TTACCTACATCTCATACT | 3-13-2 | TTAcctacatctcataCT | 109_3 | -20.48 | 60830 |
| 109 | TTACCTACATCTCATACT | 3-12-3 | TTAcctacatctcatACT | 109_4 | -21.08 | 60830 |
| 110 | TTACCTACATCTCATAC | 3-11-3 | TTAcctacatctcaTAC | 110_1 | -19.50 | 60831 |
| 110 | TTACCTACATCTCATAC | 2-13-2 | TTacctacatctcatAC | 110_2 | -16.37 | 60831 |
| 111 | GTTACCTACATCTCATA | 2-11-4 | GTtacctacatctCATA | 111_1 | -21.69 | 60832 |
| 111 | GTTACCTACATCTCATA | 2-13-2 | GTtacctacatctcaTA | 111_2 | -18.74 | 60832 |
| 111 | GTTACCTACATCTCATA | 3-12-2 | GTTacctacatctcaTA | 111_3 | -19.98 | 60832 |
| 112 | GTTACCTACATCTCAT | 3-10-3 | GTTacctacatctCAT | 112_1 | -20.69 | 60833 |
| 112 | GTTACCTACATCTCAT | 2-12-2 | GTtacctacatctcAT | 112_2 | -17.37 | 60833 |
| 113 | ATATACCCAAAGGCACCT | 3-12-3 | ATAtacccaaaggcaCCT | 113_1 | -25.99 | 62200 |
| 114 | TCTACTCATCCTTTAACTCA | 2-14-4 | TCtactcatcctttaaCTCA | 114_1 | -25.63 | 62251 |
| 115 | CCTTAATCTGTATCACT | 2-13-2 | CCttaatctgtatcaCT | 115_1 | -19.58 | 62286 |
| 116 | CCATACACAGCACATA | 2-12-2 | CCatacacagcacaTA | 116_1 | -19.04 | 62424 |
| 117 | CTCCATACACAGCACAT | 2-13-2 | CTccatacacagcacAT | 117_1 | -20.08 | 62425 |
| 118 | CAGAATAATTCTCCTCC | 2-13-2 | CAgaataattctcctCC | 118_1 | -19.86 | 62441 |
| 119 | GTCCTACATATATACC | 4-10-2 | GTCCtacatatataCC | 119_1 | -22.09 | 66380 |
| 120 | TGCTTCCTTACTAACC | 4-10-2 | TGCTtccttactaaCC | 120_1 | -23.93 | 66701 |
| 120 | TGCTTCCTTACTAACC | 2-12-2 | TGcttccttactaaCC | 120_2 | -20.10 | 66701 |
| 121 | CCCTTTGTAATCATCT | 4-10-2 | CCCTttgtaatcatCT | 121_1 | -23.44 | 66838 |
| 122 | TCCCTTTGTAATCATCT | 2-13-2 | TCccttttgtaatcatCT | 122_1 | -19.97 | 66838 |
| 123 | CTGCCATCAATACCAT | 2-12-2 | CTgccatcaataccAT | 123_1 | -19.14 | 68918 |
| 124 | TCACTGCCATCAATACC | 2-13-2 | TCactgccatcaataCC | 124_1 | -21.35 | 68920 |
| 125 | ATTCTTACTTTATTCCTCA | 2-15-2 | ATtcttactttattcctCA | 125_1 | -20.16 | 70033 |
| 126 | TCACTTTCCAGATATCA | 4-11-2 | TCACtttccagatatCA | 126_1 | -21.61 | 77567 |
| 126 | TCACTTTCCAGATATCA | 2-13-2 | TCactttccagatatCA | 126_2 | -18.65 | 77567 |
| 127 | TCCTTCAAATTCCACATAC | 3-13-3 | TCCttcaaattccacaTAC | 127_1 | -24.09 | 82053 |
| 128 | ACATGTCCCTTTATATT | 4-11-2 | ACATgtccctttataTT | 128_1 | -20.87 | 92323 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 128 | ACATGTCCCTTTATATT | 2-13-2 | ACatgtccctttataTT | 128_2 | -17.66 | 92323 |
| 128 | ACATGTCCCTTTATATT | 3-12-2 | ACAtgtccctttataTT | 128_3 | -19.13 | 92323 |
| 128 | ACATGTCCCTTTATATT | 3-11-3 | ACAtgtccctttatATT | 128_4 | -20.03 | 92323 |
| 129 | ACATGTCCCTTTATAT | 3-10-3 | ACAtgtcccttaTAT | 129_1 | -20.11 | 92324 |
| 129 | ACATGTCCCTTTATAT | 2-12-2 | ACatgtcccttatAT | 129_2 | -16.74 | 92324 |
| 130 | CCAAGAAAGGAGCAAGCT | 3-12-3 | CCAagaaaggagcaaGCT | 130_1 | -25.26 | 97146 |
| 131 | TCCAAGAAAGGAGCAAGC | 3-12-3 | TCCaagaaaggagcaAGC | 131_1 | -24.12 | 97147 |
| 132 | CTCATCCCTCCAAGAAA | 4-11-2 | CTCAtccctccaagaAA | 132_1 | -22.58 | 97156 |
| 132 | CTCATCCCTCCAAGAAA | 2-13-2 | CTcatccctccaagaAA | 132_2 | -19.83 | 97156 |
| 132 | CTCATCCCTCCAAGAAA | 3-12-2 | CTCatccctccaagaAA | 132_3 | -21.11 | 97156 |
| 133 | TCATCCCTCCAAGAAA | 4-10-2 | TCATccctccaagaAA | 133_1 | -20.41 | 97156 |
| 133 | TCATCCCTCCAAGAAA | 2-12-2 | TCatccctccaagaAA | 133_2 | -17.63 | 97156 |
| 133 | TCATCCCTCCAAGAAA | 3-11-2 | TCAtccctccaagaAA | 133_3 | -19.09 | 97156 |
| 133 | TCATCCCTCCAAGAAA | 3-10-3 | TCAtccctccaagAAA | 133_4 | -19.81 | 97156 |
| 134 | CACCTCCCTATTACATAAA | 4-13-2 | CACCtccctattacataAA | 134_1 | -24.18 | 100018 |
| 134 | CACCTCCCTATTACATAAA | 2-15-2 | CAcctccctattacataAA | 134_2 | -20.51 | 100018 |
| 135 | CACCTCCCTATTACATAA | 4-12-2 | CACCtccctattacatAA | 135_1 | -23.75 | 100019 |
| 135 | CACCTCCCTATTACATAA | 2-14-2 | CAcctccctattacatAA | 135_2 | -20.07 | 100019 |
| 136 | CCTCCCTATTACATAA | 2-12-2 | CCtccctattacatAA | 136_1 | -18.40 | 100019 |
| 137 | CTAAATCTTCCAATTCATA | 2-15-2 | CTaaatcttccaattcaTA | 137_1 | -18.12 | 106139 |
| 138 | TATCCCTTGATTATCCT | 2-13-2 | TAtcccttgattatcCT | 138_1 | -20.68 | 109406 |
| 139 | CCTCTTTGTCAAATACT | 2-13-2 | CCtctttgtcaaataCT | 139_1 | -19.30 | 110768 |
| 140 | CAGCTTATTTACCTCTT | 2-13-2 | CAgcttatttacctcTT | 140_1 | -19.30 | 114828 |
| 141 | ACTCTTTACCTCTAACACT | 4-13-2 | ACTCtttacctctaacaCT | 141_1 | -24.26 | 117468 |
| 142 | TTACTCTTTACCTCTAACAC | 3-14-3 | TTActctttacctctaaCAC | 142_1 | -23.23 | 117469 |
| 143 | CCAACCTAATACCTTAATA | 2-15-2 | CCaacctaataccttaaTA | 143_1 | -20.27 | 118639 |
| 144 | TACCAACCTAATACCTTAA | 2-15-2 | TAccaacctaataccttAA | 144_1 | -18.32 | 118641 |
| 145 | CCAATACCCACAAACC | 3-10-3 | CCAatacccacaaACC | 145_1 | -23.17 | 124162 |
| 145 | CCAATACCCACAAACC | 2-12-2 | CCaatacccacaaaCC | 145_2 | -20.85 | 124162 |
| 146 | CCATTATTCTACTTTGT | 3-11-3 | CCAttattctacttTGT | 146_1 | -21.79 | 125501 |
| 146 | CCATTATTCTACTTTGT | 2-13-2 | CCattattctactttGT | 146_2 | -18.63 | 125501 |
| 147 | CATTTCCTTATCTTCACA | 2-14-2 | CAtttccttatcttcaCA | 147_1 | -20.39 | 125529 |
| 148 | TCATTTCCTTATCTTCACA | 4-13-2 | TCATttccttatcttcaCA | 148_1 | -24.13 | 125529 |
| 149 | AATAATTCCTCATTTCCT | 2-14-2 | AAtaattcctcatttcCT | 149_1 | -18.01 | 125539 |
| 150 | ACAATAATTCCTCATTTCC | 3-13-3 | ACAataattcctcattTCC | 150_1 | -22.71 | 125540 |
| 150 | ACAATAATTCCTCATTTCC | 2-15-2 | ACaataattcctcatttCC | 150_2 | -20.23 | 125540 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 151 | TATTGAACCAATTCTA | 3-10-3 | TATtgaaccaattCTA | 151_1 | -16.93 | 4806 |
| 152 | CATATTGAACCAATTC | 4-10-2 | CATAttgaaccaatTC | 152_1 | -16.32 | 4808 |
| 153 | TCATATTGAACCAATT | 4-10-2 | TCATattgaaccaaTT | 153_1 | -16.14 | 4809 |
| 154 | CATCATATTGAACCAA | 2-10-4 | CAtcatattgaaCCAA | 154_1 | -17.65 | 4811 |
| 155 | TCATCATATTGAACCA | 3-10-3 | TCAtcatattgaaCCA | 155_1 | -19.40 | 4812 |
| 156 | CACAATCAACAACAAATA | 4-12-2 | CACAatcaacaacaaaTA | 156_1 | -16.16 | 4972 |
| 157 | TACACAATCAACAACAAAT | 4-13-2 | TACAcaatcaacaacaaAT | 157_1 | -16.76 | 4973 |
| 158 | CTGTACACAATCAACA | 4-10-2 | CTGTacacaatcaaCA | 158_1 | -19.05 | 4979 |
| 159 | CACTAATAATTCACTTT | 4-11-2 | CACTaataattcactTT | 159_1 | -16.39 | 5058 |
| 160 | CAACATTATTGACACT | 2-10-4 | CAacattattgaCACT | 160_1 | -17.17 | 5071 |
| 161 | AAACTTTCCCAACATTAT | 2-12-4 | AAactttcccaacaTTAT | 161_1 | -18.69 | 5078 |
| 162 | TCCTATATTCTCTTAAA | 4-11-2 | TCCTatattctcttaAA | 162_1 | -18.58 | 5094 |
| 163 | TTTCCTATATTCTCTTA | 4-11-2 | TTTCctatattctctTA | 163_1 | -18.69 | 5096 |
| 164 | CAAGTTTCCTATATTCT | 4-11-2 | CAAGtttcctatattCT | 164_1 | -19.97 | 5100 |
| 165 | CAAGTTTCCTATATTC | 4-10-2 | CAAGtttcctatatTC | 165_1 | -17.47 | 5101 |
| 166 | CATTCTATCTGCCAAA | 2-10-4 | CAttctatctgcCAAA | 166_1 | -18.36 | 5218 |
| 167 | CCATTCTATCTGCCAAA | 2-11-4 | CCattctatctgcCAAA | 167_1 | -22.08 | 5218 |
| 168 | TATAGCCATTCTATCT | 4-10-2 | TATAgccattctatCT | 168_1 | -20.63 | 5224 |
| 169 | TTATAGCCATTCTATCT | 4-11-2 | TTATagccattctatCT | 169_1 | -20.82 | 5224 |
| 169 | TTATAGCCATTCTATCT | 1-10-3-1-2 | TtatagccattCTAtCT | 169_2 | -20.51 | 5224 |
| 169 | TTATAGCCATTCTATCT | 2-9-1-2-3 | TTatagccattCtaTCT | 169_3 | -20.12 | 5224 |
| 169 | TTATAGCCATTCTATCT | 1-1-1-8-2-1-3 | TtAtagccattCTaTCT | 169_4 | -20.59 | 5224 |
| 169 | TTATAGCCATTCTATCT | 1-3-1-6-2-2-2 | TtatAgccattCTatCT | 169_5 | -19.97 | 5224 |
| 169 | TTATAGCCATTCTATCT | 3-8-1-3-2 | TTAtagccattCtatCT | 169_6 | -20.13 | 5224 |
| 169 | TTATAGCCATTCTATCT | 1-10-2-2-2 | TtatagccattCTatCT | 169_7 | -19.37 | 5224 |
| 169 | TTATAGCCATTCTATCT | 2-9-1-1-4 | TTatagccattCtATCT | 169_8 | -21.02 | 5224 |
| 169 | TTATAGCCATTCTATCT | 1-1-1-8-1-1-4 | TtAtagccattCtATCT | 169_9 | -19.88 | 5224 |
| 169 | TTATAGCCATTCTATCT | 1-2-1-7-1-1-4 | TtaTagccattCtATCT | 169_10 | -20.65 | 5224 |
| 169 | TTATAGCCATTCTATCT | 1-3-1-6-1-1-4 | TtatAgccattCtATCT | 169_11 | -20.38 | 5224 |
| 169 | TTATAGCCATTCTATCT | 1-10-1-1-4 | TtatagccattCtATCT | 169_12 | -19.78 | 5224 |
| 169 | TTATAGCCATTCTATCT | 3-8-1-1-1-2 | TTAtagccattCtAtCT | 169_13 | -20.22 | 5224 |
| 169 | TTATAGCCATTCTATCT | 2-1-1-7-1-1-1-2 | TTaTagccattCtAtCT | 169_14 | -19.96 | 5224 |
| 169 | TTATAGCCATTCTATCT | 2-2-1-6-1-1-1-2 | TTatAgccattCtAtCT | 169_15 | -19.69 | 5224 |
| 169 | TTATAGCCATTCTATCT | 2-9-1-1-1-2 | TTatagccattCtAtCT | 169_16 | -19.09 | 5224 |
| 169 | TTATAGCCATTCTATCT | 1-2-2-6-1-1-1-2 | TtaTAgccattCtAtCT | 169_17 | -20.35 | 5224 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 169 | TTATAGCCATTCTATCT | 1-2-1-7-1-1-1-2 | TtaTagccattCtAtCT | 169_18 | -18.72 | 5224 |
| 169 | TTATAGCCATTCTATCT | 1-3-1-6-1-1-1-2 | TtatAgccattCtAtCT | 169_19 | -18.45 | 5224 |
| 169 | TTATAGCCATTCTATCT | 2-2-1-6-1-2-3 | TTatAgccattCtaTCT | 169_20 | -20.71 | 5224 |
| 169 | TTATAGCCATTCTATCT | 1-1-2-7-1-2-3 | TtATagccattCtaTCT | 169_21 | -20.65 | 5224 |
| 169 | TTATAGCCATTCTATCT | 1-1-1-1-1-6-1-2-3 | TtAtAgccattCtaTCT | 169_22 | -19.57 | 5224 |
| 169 | TTATAGCCATTCTATCT | 1-1-1-8-1-2-3 | TtAtagccattCtaTCT | 169_23 | -18.98 | 5224 |
| 169 | TTATAGCCATTCTATCT | 4-7-1-3-2 | TTTAgccattCtatCT | 169_24 | -21.80 | 5224 |
| 169 | TTATAGCCATTCTATCT | 3-1-1-6-1-3-2 | TTAtAgccattCtatCT | 169_25 | -20.72 | 5224 |
| 169 | TTATAGCCATTCTATCT | 2-1-1-7-1-3-2 | TTaTagccattCtatCT | 169_26 | -19.86 | 5224 |
| 169 | TTATAGCCATTCTATCT | 2-2-1-6-1-3-2 | TTatAgccattCtatCT | 169_27 | -19.59 | 5224 |
| 169 | TTATAGCCATTCTATCT | 2-9-1-3-2 | TTatagccattCtatCT | 169_28 | -18.99 | 5224 |
| 169 | TTATAGCCATTCTATCT | 1-1-3-6-1-3-2 | TtATAgccattCtatCT | 169_29 | -21.16 | 5224 |
| 169 | TTATAGCCATTCTATCT | 1-1-2-7-1-3-2 | TtATagccattCtatCT | 169_30 | -19.53 | 5224 |
| 169 | TTATAGCCATTCTATCT | 1-1-1-1-1-6-1-3-2 | TtAtAgccattCtatCT | 169_31 | -18.45 | 5224 |
| 169 | TTATAGCCATTCTATCT | 1-2-2-6-1-3-2 | TtaTAgccattCtatCT | 169_32 | -20.25 | 5224 |
| 169 | TTATAGCCATTCTATCT | 1-2-1-7-1-3-2 | TtaTagccattCtatCT | 169_33 | -18.62 | 5224 |
| 169 | TTATAGCCATTCTATCT | 1-3-1-6-1-3-2 | TtatAgccattCtatCT | 169_34 | -18.35 | 5224 |
| 169 | TTATAGCCATTCTATCT | 1-1-1-9-5 | TtAtagccattcTATCT | 169_35 | -20.88 | 5224 |
| 169 | TTATAGCCATTCTATCT | 2-10-2-1-2 | TTatagccattcTAtCT | 169_36 | -20.09 | 5224 |
| 169 | TTATAGCCATTCTATCT | 1-1-1-9-2-1-2 | TtAtagccattcTAtCT | 169_37 | -18.95 | 5224 |
| 169 | TTATAGCCATTCTATCT | 1-2-1-8-2-1-2 | TtaTagccattcTAtCT | 169_38 | -19.72 | 5224 |
| 169 | TTATAGCCATTCTATCT | 1-3-1-7-2-1-2 | TtatAgccattcTAtCT | 169_39 | -19.44 | 5224 |
| 169 | TTATAGCCATTCTATCT | 1-11-2-1-2 | TtatagccattcTAtCT | 169_40 | -18.85 | 5224 |
| 169 | TTATAGCCATTCTATCT | 3-9-1-1-3 | TTAtagccattcTaTCT | 169_41 | -21.21 | 5224 |
| 169 | TTATAGCCATTCTATCT | 1-1-1-9-1-1-3 | TtAtagccattcTaTCT | 169_42 | -18.94 | 5224 |
| 169 | TTATAGCCATTCTATCT | 3-9-1-2-2 | TTAtagccattcTatCT | 169_43 | -20.09 | 5224 |
| 169 | TTATAGCCATTCTATCT | 1-2-1-8-1-2-2 | TtaTagccattcTatCT | 169_44 | -18.58 | 5224 |
| 169 | TTATAGCCATTCTATCT | 1-3-1-7-1-2-2 | TtatAgccattcTatCT | 169_45 | -18.31 | 5224 |
| 169 | TTATAGCCATTCTATCT | 1-1-1-10-4 | TtAtagccattctATCT | 169_46 | -18.90 | 5224 |
| 169 | TTATAGCCATTCTATCT | 3-10-1-1-2 | TTAtagccattctAtCT | 169_47 | -19.24 | 5224 |
| 169 | TTATAGCCATTCTATCT | 2-11-1-1-2 | TTatagccattctAtCT | 169_48 | -18.11 | 5224 |
| 169 | TTATAGCCATTCTATCT | 1-2-2-8-1-1-2 | TtaTagccattctAtCT | 169_49 | -19.37 | 5224 |
| 169 | TTATAGCCATTCTATCT | 3-1-1-10-2 | TTAtAgccattctatCT | 169_50 | -19.74 | 5224 |
| 169 | TTATAGCCATTCTATCT | 3-12-2 | TTAtagccattctatCT | 169_51 | -19.15 | 5224 |
| 169 | TTATAGCCATTCTATCT | 2-1-2-10-2 | TTaTAgccattctatCT | 169_52 | -20.51 | 5224 |
| 169 | TTATAGCCATTCTATCT | 2-1-1-11-2 | TTaTagccattctatCT | 169_53 | -18.88 | 5224 |

TABLE 3-continued

List of oligonucleotides or contiguous nucleobase sequences complementary to SEQ
ID NO: 1 (motif sequences indicated by SEQ ID NO), oligonucleotide designs made from these,
as well as specific oligonucleotide compounds (indicated by CMP ID NO) designed based on
the motif sequence.

| Seq ID NO | Motif | Design | Compound | CMP ID NO | ΔG° | Start SEQ ID NO 1 |
|---|---|---|---|---|---|---|
| 169 | TTATAGCCATTCTATCT | 2-2-1-10-2 | TTatAgccattctatCT | 169_54 | -18.61 | 5224 |
| 169 | TTATAGCCATTCTATCT | 2-13-2 | TTatagccattctatCT | 169_55 | -18.02 | 5224 |
| 169 | TTATAGCCATTCTATCT | 1-1-3-10-2 | TtATAgccattctatCT | 169_56 | -20.18 | 5224 |
| 169 | TTATAGCCATTCTATCT | 1-1-2-11-2 | TtATagccattctatCT | 169_57 | -18.55 | 5224 |
| 169 | TTATAGCCATTCTATCT | 2-9-3-1-2 | TTatagccattCTAtCT | 169_58 | -21.75 | 5224 |
| 169 | TTATAGCCATTCTATCT | 1-1-1-8-2-2-2 | TtAtagccattCTatCT | 169_59 | -19.47 | 5224 |
| 169 | TTATAGCCATTCTATCT | 1-2-2-6-2-2-2 | TtaTAgccattCTatCT | 169_60 | -21.87 | 5224 |
| 169 | TTATAGCCATTCTATCT | 1-1-3-6-1-1-1-1-2 | TtATAgccattCtAtCT | 169_61 | -21.25 | 5224 |
| 169 | TTATAGCCATTCTATCT | 3-8-1-2-3 | TTAtagccattCtaTCT | 169_62 | -21.25 | 5224 |
| 170 | ATTTAAATTTCCAAACATT | 2-13-4 | ATttaaatttccaaaCATT | 170_1 | -16.82 | 5427 |
| 171 | GCTAATTTAAATTTCC | 4-10-2 | GCTAatttaaatttCC | 171_1 | -18.50 | 5434 |
| 172 | ATCAATATCTTCTCAC | 3-10-3 | ATCaatatcttctCAC | 172_1 | -17.10 | 5785 |
| 173 | TATCAATATCTTCTCA | 2-10-4 | TAtcaatatcttCTCA | 173_1 | -17.55 | 5786 |
| 174 | CTACAAATTCAATTTACT | 2-12-4 | CTacaaattcaattTACT | 174_1 | -17.38 | 6341 |
| 175 | TCTTACTCTGACTTTCCA | 2-14-2 | TCttactctgactttcCA | 175_1 | -21.47 | 6694 |
| 176 | TCTTACTCTGACTTTCC | 2-12-3 | TCttactctgactttTCC | 176_1 | -21.53 | 6695 |
| 177 | AAATTTCCAAACCTTTC | 2-11-4 | AAatttccaaaccTTTC | 177_1 | -16.30 | 6958 |
| 178 | CTTCTTGTTTATCCCAA | 2-11-4 | CTtcttgtttatcCCAA | 178_1 | -22.77 | 7159 |
| 179 | TTCTTGTTTATCCCAA | 2-10-4 | TTcttgtttatcCCAA | 179_1 | -20.17 | 7159 |
| 180 | ATGCTTCTAACTAACA | 4-10-2 | ATGCttctaactaaCA | 180_1 | -19.21 | 7720 |
| 181 | CTTTAATGCTTCTAACT | 4-11-2 | CTTTaatgcttctaaCT | 181_1 | -18.49 | 7724 |
| 182 | CCTTTAATGCTTCTAAC | 2-11-4 | CCtttaatgcttcTAAC | 182_1 | -20.06 | 7725 |
| 183 | CTTTAATGCTTCTAAC | 2-10-4 | CTttaatgcttcTAAC | 183_1 | -16.07 | 7725 |
| 184 | TTCCTTTAATGCTTCTA | 4-11-2 | TTCCtttaatgcttcTA | 184_1 | -21.59 | 7727 |
| 185 | TATACCTTTCTTTAACCCT | 2-15-2 | TAtacctttctttaaccCT | 185_1 | -22.03 | 8117 |
| 186 | ATACCTTTCTTTAACCC | 4-11-2 | ATACctttctttaacCC | 186_1 | -22.68 | 8118 |
| 187 | TTATACCTTTCTTTAACC | 4-12-2 | TTATacctttctttaaCC | 187_1 | -21.52 | 8119 |
| 188 | TTTATACCTTTCTTTAAC | 2-12-4 | TTtatacctttcttTAAC | 188_1 | -17.01 | 8120 |
| 189 | TCAAGAATTCTCTCCTT | 2-11-4 | TCaagaattctctCCTT | 189_1 | -21.29 | 8571 |
| 190 | TTCAAGAATTCTCTCC | 2-10-4 | TTcaagaattctCTCC | 190_1 | -19.38 | 8573 |
| 191 | CTTCAAGAATTCTCTC | 2-10-4 | CTtcaagaattcTCTC | 191_1 | -18.00 | 8574 |
| 192 | TCTTCAAGAATTCTCT | 2-10-4 | TCttcaagaattCTCT | 192_1 | -18.46 | 8575 |
| 193 | ATCTTCAAGAATTCTC | 3-10-3 | ATCttcaagaattCTC | 193_1 | -17.04 | 8576 |
| 194 | TTTCTTACTATCTTCA | 4-10-2 | TTTCttactatcttCA | 194_1 | -17.47 | 8585 |
| 195 | CCTTTAGCATTTCTATT | 2-11-4 | CCtttagcatttcTATT | 195_1 | -21.72 | 8819 |

TABLE 3-continued

List of oligonucleotides or contiguous nucleobase sequences complementary to SEQ
ID NO: 1 (motif sequences indicated by SEQ ID NO), oligonucleotide designs made from these,
as well as specific oligonucleotide compounds (indicated by CMP ID NO) designed based on
the motif sequence.

| Seq ID NO | Motif | Design | Compound | CMP ID NO | ΔG° | Start SEQ ID NO 1 |
|---|---|---|---|---|---|---|
| 196 | TCCTTTAGCATTTCTAT | 3-11-3 | TCCttagcatttcTAT | 196_1 | −22.39 | 8820 |
| 197 | GTTCTCTTTATTTCTTCT | 2-12-4 | GTtctctttatttcTTCT | 197_1 | −21.76 | 8887 |
| 198 | TTTACTGTCAACTCCT | 2-10-4 | TTtactgtcaacTCCT | 198_1 | −20.83 | 9150 |
| 199 | TTTCCAATGAATCTAT | 2-10-4 | TTtccaatgaatCTAT | 199_1 | −16.61 | 9201 |
| 200 | CCTTTCCAATGAATCTA | 2-11-4 | CCtttccaatgaaTCTA | 200_1 | −22.34 | 9202 |
| 201 | CTTTCCAATGAATCTA | 2-10-4 | CTttccaatgaaTCTA | 201_1 | −18.34 | 9202 |
| 202 | CCTTTCCAATGAATCT | 3-10-3 | CCTttccaatgaaTCT | 202_1 | −21.30 | 9203 |
| 203 | TTATACCCTTTCCAAT | 2-10-4 | TTataccctttcCAAT | 203_1 | −19.61 | 9209 |
| 204 | GTTTATACCCTTTCCAA | 3-11-3 | GTTtataccctttcCAA | 204_1 | −21.88 | 9210 |
| 205 | TTTATACCCTTTCCAA | 2-10-4 | TTtataccctttCCAA | 205_1 | −20.50 | 9210 |
| 206 | GTTTATACCCTTTCCA | 2-11-3 | GTtataccctttCCA | 206_1 | −22.69 | 9211 |
| 207 | TGTTTATACCCTTTCCA | 3-12-2 | TGTttataccctttcCA | 207_1 | −22.80 | 9211 |
| 208 | ACTGTTTATACCCTTTCC | 2-14-2 | ACtgtttataccctttCC | 208_1 | −22.96 | 9212 |
| 208 | ACTGTTTATACCCTTTCC | 1-11-1-3-2 | ActgtttataccCtttCC | 208_2 | −22.45 | 9212 |
| 208 | ACTGTTTATACCCTTTCC | 1-2-1-10-1-1-2 | ActGtttataccctTtCC | 208_3 | −22.17 | 9212 |
| 208 | ACTGTTTATACCCTTTCC | 1-2-1-1-1-10-2 | ActGtTtataccctttCC | 208_4 | −22.17 | 9212 |
| 208 | ACTGTTTATACCCTTTCC | 1-2-1-12-2 | ActGtttataccctttCC | 208_5 | −21.87 | 9212 |
| 208 | ACTGTTTATACCCTTTCC | 1-3-1-11-2 | ActgTttataccctttCC | 208_6 | −22.22 | 9212 |
| 208 | ACTGTTTATACCCTTTCC | 1-15-2 | ActgtttataccctttCC | 208_7 | −21.56 | 9212 |
| 209 | ACTGTTTATACCCTTTC | 4-11-2 | ACTGtttataccctttTC | 209_1 | −21.65 | 9213 |
| 209 | ACTGTTTATACCCTTTC | 1-11-1-2-2 | ActgtttataccCttTC | 209_2 | −18.25 | 9213 |
| 209 | ACTGTTTATACCCTTTC | 1-1-1-8-1-1-1-1-2 | AcTgtttatacCcTtTC | 209_3 | −19.56 | 9213 |
| 209 | ACTGTTTATACCCTTTC | 1-2-1-9-4 | ActGtttataccTTTC | 209_4 | −19.51 | 9213 |
| 209 | ACTGTTTATACCCTTTC | 1-3-1-6-1-2-3 | ActgTttatacCctTTC | 209_5 | −19.51 | 9213 |
| 209 | ACTGTTTATACCCTTTC | 2-9-1-3-2 | ACtgtttataCctTtTC | 209_6 | −19.43 | 9213 |
| 209 | ACTGTTTATACCCTTTC | 1-2-1-7-1-3-2 | ActGtttatacCctTtTC | 209_7 | −18.35 | 9213 |
| 209 | ACTGTTTATACCCTTTC | 1-3-1-8-1-1-2 | ActgTttataccCTtTC | 209_8 | −18.53 | 9213 |
| 209 | ACTGTTTATACCCTTTC | 1-11-1-1-3 | ActgtttataccCtTTC | 209_9 | −19.06 | 9213 |
| 209 | ACTGTTTATACCCTTTC | 2-10-1-2-2 | ACtgtttataccCttTC | 209_10 | −19.64 | 9213 |
| 210 | AACTGTTTATACCCTTT | 4-11-2 | AACTgtttataccctTT | 210_1 | −19.51 | 9214 |
| 211 | TATGACTCCAATAATC | 3-10-3 | TATgactccaataATC | 211_1 | −16.57 | 10832 |
| 212 | CTCCTTTATGACTCCAA | 4-11-2 | CTCCtttatgactccAA | 212_1 | −22.74 | 10837 |
| 213 | CTCCTTTATGACTCCA | 3-11-2 | CTCctttatgactcCA | 213_1 | −21.50 | 10838 |
| 214 | CCATTATTTCTTAAATA | 4-11-2 | CCATtatttcttaaaTA | 214_1 | −17.56 | 10877 |
| 215 | ATTTCATATTACTAACTA | 2-12-4 | ATttcatattactaACTA | 215_1 | −16.64 | 11434 |
| 216 | CATTTCATATTACTAACT | 3-12-3 | CATttcatattactaACT | 216_1 | −17.70 | 11435 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 217 | TCATTTCATATTACTAAC | 4-12-2 | TCATttcatattacta AC | 217_1 | -16.72 | 11436 |
| 218 | ATCATTTCATATTACTA | 3-11-3 | ATCatttcatattaCTA | 218_1 | -17.23 | 11438 |
| 219 | TTATCATTTCATATTACT | 4-12-2 | TTATcatttcatattaCT | 219_1 | -17.77 | 11439 |
| 220 | TGTACTTTCCTTTACCA | 2-13-2 | TGtactttcctttacCA | 220_1 | -20.37 | 11464 |
| 221 | TATACACCATCATTATA | 4-11-2 | TATAcaccatcattaTA | 221_1 | -18.48 | 11507 |
| 222 | TTATACACCATCATTAT | 3-11-3 | TTAtacaccatcatTAT | 222_1 | -17.83 | 11508 |
| 223 | TATTTATACACCATCAT | 3-11-3 | TATttatacaccatCAT | 223_1 | -18.54 | 11511 |
| 224 | TTATTTATACACCATC | 2-10-4 | TTatttatacacCATC | 224_1 | -16.60 | 11513 |
| 225 | AATTATTTATACACCAT | 2-11-4 | AAttatttatacaCCAT | 225_1 | -16.82 | 11514 |
| 226 | CATGACACTTACATAA | 3-10-3 | CATgacacttacaTAA | 226_1 | -16.26 | 11736 |
| 227 | AGTTCACTACTATTAC | 3-10-3 | AGTtcactactatTAC | 227_1 | -17.55 | 12361 |
| 228 | ATAAGCTTACCTCATA | 2-10-4 | ATaagcttacctCATA | 228_1 | -19.32 | 12794 |
| 229 | TATAAGCTTACCTCAT | 3-10-3 | TATaagcttacctCAT | 229_1 | -19.32 | 12795 |
| 230 | ATATAAGCTTACCTCA | 4-10-2 | ATATaagcttacctCA | 230_1 | -19.32 | 12796 |
| 231 | CTTCCCTTTGATAACAT | 3-11-3 | CTTccctttgataaCAT | 231_1 | -21.19 | 12894 |
| 232 | TTCCCTTTGATAACAT | 4-10-2 | TTCCctttgataacAT | 232_1 | -19.27 | 12894 |
| 233 | CCTTCCCTTTGATAACA | 2-12-3 | CCttccctttgataACA | 233_1 | -23.06 | 12895 |
| 234 | CTTCCCTTTGATAACA | 4-10-2 | CTTCcctttgataaCA | 234_1 | -20.51 | 12895 |
| 235 | CCTTCCCTTTGATAAC | 3-11-2 | CCTtccctttgataAC | 235_1 | -20.96 | 12896 |
| 236 | TTGATTCAATTCCCTTA | 2-11-4 | TTgattcaattccCTTA | 236_1 | -20.48 | 13223 |
| 236 | TTGATTCAATTCCCTTA | 2-9-1-1-1-1-2 | TTgattcaattCcCtTA | 236_2 | -19.54 | 13223 |
| 236 | TTGATTCAATTCCCTTA | 2-10-1-1-3 | TTgattcaattcCcTTA | 236_3 | -19.59 | 13223 |
| 236 | TTGATTCAATTCCCTTA | 2-1-1-8-1-2-2 | TTgAttcaattcCctTA | 236_4 | -19.06 | 13223 |
| 236 | TTGATTCAATTCCCTTA | 2-2-1-7-1-2-2 | TTgaTtcaattcCctTA | 236_5 | -19.00 | 13223 |
| 236 | TTGATTCAATTCCCTTA | 2-9-1-3-2 | TTgattcaattCcctTA | 236_6 | -18.65 | 13223 |
| 236 | TTGATTCAATTCCCTTA | 1-2-2-6-2-2-2 | TtgATtcaattCCctTA | 236_7 | -21.37 | 13223 |
| 236 | TTGATTCAATTCCCTTA | 2-1-1-7-1-1-1-2 | TTgAttcaattCcCtTA | 236_8 | -20.04 | 13223 |
| 236 | TTGATTCAATTCCCTTA | 1-1-2-7-1-1-1-2 | TtGAttcaattCcCtTA | 236_9 | -20.10 | 13223 |
| 236 | TTGATTCAATTCCCTTA | 1-2-1-9-4 | TtgAttcaattccCTTA | 236_10 | -19.67 | 13223 |
| 236 | TTGATTCAATTCCCTTA | 1-3-1-6-1-1-1-2 | TtgaTtcaattCcCtTA | 236_11 | -18.67 | 13223 |
| 236 | TTGATTCAATTCCCTTA | 2-10-1-2-2 | TTgattcaattcCctTA | 236_12 | -18.56 | 13223 |
| 236 | TTGATTCAATTCCCTTA | 1-2-2-7-2-1-2 | TtgATtcaattcCCtTA | 236_13 | -21.49 | 13223 |
| 236 | TTGATTCAATTCCCTTA | 1-1-2-8-1-2-2 | TtGAttcaattcCctTA | 236_14 | -19.13 | 13223 |
| 236 | TTGATTCAATTCCCTTA | 2-11-1-1-2 | TTgattcaattccCtTA | 236_15 | -18.77 | 13223 |
| 236 | TTGATTCAATTCCCTTA | 1-1-1-1-1-8-1-1-2 | TtGaTtcaattccCtTA | 236_16 | -18.07 | 13223 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 236 | TTGATTCAATTCCCTTA | 1-1-2-7-2-2-2 | TtGAttcaattCCctTA | 236_17 | -21.50 | 13223 |
| 236 | TTGATTCAATTCCCTTA | 1-2-1-7-1-1-4 | TtgAttcaattCcCTTA | 236_18 | -20.44 | 13223 |
| 236 | TTGATTCAATTCCCTTA | 3-8-1-1-1-1-2 | TTGattcaattCcCtTA | 236_19 | -20.60 | 13223 |
| 236 | TTGATTCAATTCCCTTA | 2-2-1-6-1-3-2 | TTgaTtcaattCcctTA | 236_20 | -19.09 | 13223 |
| 236 | TTGATTCAATTCCCTTA | 2-2-1-7-2-1-2 | TTgaTtcaattcCCtTA | 236_21 | -21.49 | 13223 |
| 237 | ATTGATTCAATTCCCTT | 2-11-4 | ATtgattcaattcCCTT | 237_1 | -21.28 | 13224 |
| 237 | ATTGATTCAATTCCCTT | 3-8-3-1-2 | ATTgattcaatTCCcTT | 237_2 | -22.78 | 13224 |
| 237 | ATTGATTCAATTCCCTT | 1-1-1-8-3-1-2 | AtTgattcaatTCCcTT | 237_3 | -21.02 | 13224 |
| 237 | ATTGATTCAATTCCCTT | 1-2-1-8-2-1-2 | AttGattcaattCCcTT | 237_4 | -19.40 | 13224 |
| 237 | ATTGATTCAATTCCCTT | 1-3-1-7-2-1-2 | AttgAttcaattCCcTT | 237_5 | -19.74 | 13224 |
| 237 | ATTGATTCAATTCCCTT | 1-2-1-7-2-1-3 | AttGattcaatTCcCTT | 237_6 | -19.67 | 13224 |
| 237 | ATTGATTCAATTCCCTT | 2-2-1-7-1-1-3 | ATtgAttcaattCcCTT | 237_7 | -20.27 | 13224 |
| 237 | ATTGATTCAATTCCCTT | 1-1-1-9-1-1-3 | AtTgattcaattCcCTT | 237_8 | -19.32 | 13224 |
| 237 | ATTGATTCAATTCCCTT | 1-3-1-7-1-1-3 | AttgAttcaattCcCTT | 237_9 | -19.02 | 13224 |
| 237 | ATTGATTCAATTCCCTT | 1-1-1-1-1-7-2-1-2 | AtTgAttcaattCCcTT | 237_10 | -20.53 | 13224 |
| 237 | ATTGATTCAATTCCCTT | 1-2-2-7-2-1-2 | AttGAttcaattCCcTT | 237_11 | -21.11 | 13224 |
| 237 | ATTGATTCAATTCCCTT | 1-2-1-8-1-1-3 | AttGattcaattCcCTT | 237_12 | -18.68 | 13224 |
| 237 | ATTGATTCAATTCCCTT | 1-1-2-8-1-2-2 | AtTGattcaattCccTT | 237_13 | -18.81 | 13224 |
| 237 | ATTGATTCAATTCCCTT | 3-10-1-1-2 | ATTgattcaattcCcTT | 237_14 | -19.42 | 13224 |
| 237 | ATTGATTCAATTCCCTT | 1-1-2-9-4 | AtTGattcaattcCCTT | 237_15 | -21.89 | 13224 |
| 237 | ATTGATTCAATTCCCTT | 2-2-1-8-1-1-2 | ATtgAttcaattcCcTT | 237_16 | -18.61 | 13224 |
| 237 | ATTGATTCAATTCCCTT | 1-2-2-6-3-1-2 | AttGAttcaatTCCcTT | 237_17 | -22.09 | 13224 |
| 237 | ATTGATTCAATTCCCTT | 1-1-1-8-2-1-3 | AtTgattcaatTCcCTT | 237_18 | -20.30 | 13224 |
| 237 | ATTGATTCAATTCCCTT | 1-1-1-9-2-1-2 | AtTgattcaattCCcTT | 237_19 | -20.03 | 13224 |
| 237 | ATTGATTCAATTCCCTT | 1-1-1-1-1-7-1-1-3 | AtTgAttcaattCcCTT | 237_20 | -19.82 | 13224 |
| 237 | ATTGATTCAATTCCCTT | 3-1-1-8-1-1-2 | ATTgAttcaattcCcTT | 237_21 | -19.92 | 13224 |
| 238 | TTGATTCAATTCCCTT | 2-10-4 | TTgattcaattcCCTT | 238_1 | -20.52 | 13224 |
| 239 | TATTGATTCAATTCCCT | 2-11-4 | TAttgattcaattCCCT | 239_1 | -22.82 | 13225 |
| 239 | TATTGATTCAATTCCCT | 3-9-2-1-2 | TATtgattcaatTCcCT | 239_2 | -21.17 | 13225 |
| 239 | TATTGATTCAATTCCCT | 2-9-1-1-1-2 | TAttgattcaaTtCcCT | 239_3 | -19.37 | 13225 |
| 239 | TATTGATTCAATTCCCT | 1-2-1-7-3-1-2 | TaTTgattcaaTTCcCT | 239_4 | -21.49 | 13225 |
| 239 | TATTGATTCAATTCCCT | 1-3-1-6-3-1-2 | TattGattcaaTTCcCT | 239_5 | -19.90 | 13225 |
| 239 | TATTGATTCAATTCCCT | 2-9-1-2-3 | TAttgattcaaTtcCCT | 239_6 | -20.89 | 13225 |
| 239 | TATTGATTCAATTCCCT | 1-10-1-2-3 | TattgattcaaTtcCCT | 239_7 | -19.76 | 13225 |
| 239 | TATTGATTCAATTCCCT | 1-1-1-1-1-8-1-1-2 | TaTtGattcaattCcCT | 239_8 | -18.41 | 13225 |
| 239 | TATTGATTCAATTCCCT | 1-2-2-8-1-1-2 | TatTGattcaattCcCT | 239_9 | -19.66 | 13225 |

TABLE 3-continued

List of oligonucleotides or contiguous nucleobase sequences complementary to SEQ
ID NO: 1 (motif sequences indicated by SEQ ID NO), oligonucleotide designs made from these,
as well as specific oligonucleotide compounds (indicated by CMP ID NO) designed based on
the motif sequence.

| Seq ID NO | Motif | Design | Compound | CMP ID NO | ΔG° | Start SEQ ID NO 1 |
|---|---|---|---|---|---|---|
| 239 | TATTGATTCAATTCCCT | 1-2-1-9-1-1-2 | TatTgattcaattCcCT | 239_10 | -18.60 | 13225 |
| 239 | TATTGATTCAATTCCCT | 2-2-1-10-2 | TAttGattcaattccCT | 239_11 | -18.33 | 13225 |
| 239 | TATTGATTCAATTCCCT | 1-12-4 | TattgattcaattCCCT | 239_12 | -21.69 | 13225 |
| 239 | TATTGATTCAATTCCCT | 2-1-1-9-1-1-2 | TAtTgattcaattCcCT | 239_13 | -19.73 | 13225 |
| 239 | TATTGATTCAATTCCCT | 2-12-3 | TAttgattcaattcCCT | 239_14 | -20.45 | 13225 |
| 239 | TATTGATTCAATTCCCT | 1-2-1-10-3 | TatTgattcaattcCCT | 239_15 | -20.11 | 13225 |
| 239 | TATTGATTCAATTCCCT | 1-1-3-10-2 | TaTTGattcaattccCT | 239_16 | -19.84 | 13225 |
| 239 | TATTGATTCAATTCCCT | 1-1-1-1-1-6-3-1-2 | TaTtGattcaaTTCcCT | 239_17 | -20.34 | 13225 |
| 239 | TATTGATTCAATTCCCT | 2-2-1-6-1-1-1-2 | TAttGattcaaTtCcCT | 239_18 | -19.54 | 13225 |
| 239 | TATTGATTCAATTCCCT | 2-1-1-8-2-1-2 | TAtTgattcaatTCcCT | 239_19 | -20.72 | 13225 |
| 239 | TATTGATTCAATTCCCT | 1-1-2-9-1-1-2 | TaTTgattcaattCcCT | 239_20 | -19.55 | 13225 |
| 239 | TATTGATTCAATTCCCT | 2-1-1-10-3 | TAtTgattcaattcCCT | 239_21 | -21.24 | 13225 |
| 240 | TATTGATTCAATTCCC | 3-10-3 | TATtgattcaattCCC | 240_1 | -20.58 | 13226 |
| 241 | GCACATTCTTTCTATAC | 3-11-3 | GCAcattctttctaTAC | 241_1 | -21.17 | 15115 |
| 241 | GCACATTCTTTCTATAC | 1-1-3-6-2-2-2 | GcACAttctttCTatAC | 241_2 | -20.68 | 15115 |
| 241 | GCACATTCTTTCTATAC | 1-1-1-1-1-6-1-2-3 | GcAcAttctttCtaTAC | 241_3 | -18.46 | 15115 |
| 241 | GCACATTCTTTCTATAC | 1-1-2-7-1-2-3 | GcACattctttCtaTAC | 241_4 | -19.49 | 15115 |
| 241 | GCACATTCTTTCTATAC | 2-9-1-3-2 | GCacattctttCtatAC | 241_5 | -18.68 | 15115 |
| 241 | GCACATTCTTTCTATAC | 1-1-3-8-4 | GcACAttctttctATAC | 241_6 | -20.89 | 15115 |
| 241 | GCACATTCTTTCTATAC | 2-2-1-9-3 | GCacAttctttctaTAC | 241_7 | -19.66 | 15115 |
| 241 | GCACATTCTTTCTATAC | 2-1-1-11-2 | GCaCattctttctatAC | 241_8 | -18.39 | 15115 |
| 241 | GCACATTCTTTCTATAC | 1-1-3-9-3 | GcACAttctttctaTAC | 241_9 | -19.98 | 15115 |
| 241 | GCACATTCTTTCTATAC | 3-12-2 | GCAcattctttctatAC | 241_10 | -19.27 | 15115 |
| 241 | GCACATTCTTTCTATAC | 1-1-1-1-1-6-1-1-4 | GcAcAttctttCtATAC | 241_11 | -19.36 | 15115 |
| 241 | GCACATTCTTTCTATAC | 3-8-1-1-1-2 | GCAcattctttCtAtAC | 241_12 | -20.34 | 15115 |
| 241 | GCACATTCTTTCTATAC | 2-1-1-7-1-2-3 | GCaCattctttCtaTAC | 241_13 | -21.27 | 15115 |
| 241 | GCACATTCTTTCTATAC | 1-2-2-8-4 | GcaCAttctttctATAC | 241_14 | -20.33 | 15115 |
| 241 | GCACATTCTTTCTATAC | 1-1-3-10-2 | GcACAttctttctatAC | 241_15 | -18.08 | 15115 |
| 242 | GAATTTCAACTACTAT | 2-10-4 | GAatttcaactaCTAT | 242_1 | -16.13 | 15258 |
| 243 | CCATTTATTTCCATTTAT | 3-12-3 | CCAtttatttccattTAT | 243_1 | -21.92 | 15568 |
| 244 | TTTCCATTTATTTCCATTT | 4-13-2 | TTTCcatttatttccatTT | 244_1 | -20.93 | 15570 |
| 244 | TTTCCATTTATTTCCATTT | 1-4-1-7-1-1-4 | TttccAtttatttCcATTT | 244_2 | -20.48 | 15570 |
| 244 | TTTCCATTTATTTCCATTT | 2-1-1-10-2-1-2 | TTTCcatttatttcCAtTT | 244_3 | -21.47 | 15570 |
| 244 | TTTCCATTTATTTCCATTT | 1-2-1-1-1-7-1-3-2 | TttCcAtttatttCcatTT | 244_4 | -19.43 | 15570 |
| 244 | TTTCCATTTATTTCCATTT | 2-2-2-11-2 | TTtcCAtttatttccatTT | 244_5 | -20.70 | 15570 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 245 | CTTTCCATTTATTTCCAT | 3-12-3 | CTTtccatttatttcCAT | 245_1 | -22.31 | 15572 |
| 246 | TCTTTCCATTTATTTCCA | 4-12-2 | TCTTtccatttatttcCA | 246_1 | -22.74 | 15573 |
| 247 | ATCTTTCCATTTATTTCC | 3-12-3 | ATCtttccatttattTCC | 247_1 | -22.85 | 15574 |
| 248 | TTCCATGCAAACTTTA | 4-10-2 | TTCCatgcaaactTTA | 248_1 | -19.01 | 15722 |
| 249 | CAGTTTAAATTCACAC | 3-10-3 | CAGtttaaattcaCAC | 249_1 | -16.68 | 16597 |
| 250 | CTATTCCAGTTTAAAT | 4-10-2 | CTATtccagtttaaAT | 250_1 | -16.86 | 16603 |
| 251 | TGCAAATACCTCTTCA | 4-10-2 | TGCAaatacctcttCA | 251_1 | -21.49 | 16730 |
| 252 | CTAAATAGATTCCACT | 2-10-4 | CTaaatagattcCACT | 252_1 | -17.95 | 16849 |
| 253 | TATTGATATTTACTCT | 2-10-4 | TAttgatatttaCTCT | 253_1 | -16.32 | 17089 |
| 254 | CCTTAGTATTACAATT | 4-10-2 | CCTTagtattacaaTT | 254_1 | -17.43 | 17401 |
| 255 | CTATTCAATAAACTAAACA | 4-13-2 | CTATtcaataaactaaaCA | 255_1 | -16.45 | 24290 |
| 256 | CAGCTATTCAATAAAC | 4-10-2 | CAGCtattcaataaAC | 256_1 | -16.94 | 24296 |
| 257 | TATAGACCCAAACTAT | 3-10-3 | TATagacccaaacTAT | 257_1 | -18.15 | 24811 |
| 258 | TAATCCCATACATCTAT | 2-11-4 | TAatcccatacatCTAT | 258_1 | -20.45 | 25032 |
| 259 | ATAATCCCATACATCTA | 3-11-3 | ATAatcccatacatCTA | 259_1 | -20.45 | 25033 |
| 260 | ATCTCAACTACCATTT | 4-10-2 | ATCTcaactaccatTT | 260_1 | -18.14 | 25250 |
| 261 | AATCTCAACTACCATT | 4-10-2 | AATCtcaactaccaTT | 261_1 | -16.76 | 25251 |
| 262 | ACAACTTCTATCATAC | 3-10-3 | ACAacttctatcaTAC | 262_1 | -16.33 | 25718 |
| 263 | GAACAACTTCTATCAT | 2-10-4 | GAacaacttctaTCAT | 263_1 | -16.94 | 25720 |
| 264 | TGAACAACTTCTATCA | 3-10-3 | TGAacaacttctaTCA | 264_1 | -17.36 | 25721 |
| 265 | TACACAAATACTTAAATCA | 4-13-2 | TACAcaaatacttaaatCA | 265_1 | -16.93 | 26331 |
| 266 | TTAAGCTTTCACCTAT | 2-10-4 | TTaagctttcacCTAT | 266_1 | -19.36 | 27165 |
| 267 | AAACTCTTGCATCTACT | 2-13-2 | AAactcttgcatctaCT | 267_1 | -16.65 | 27248 |
| 268 | AAATTTCTCAACCTAAATTT | 2-14-4 | AAatttctcaacctaaATTT | 268_1 | -16.78 | 29330 |
| 269 | CCAACATAGATCCTCT | 2-10-4 | CCaacatagatcCTCT | 269_1 | -22.49 | 29635 |
| 270 | TCCAACATAGATCCTCT | 2-11-4 | TCcaacatagatcCTCT | 270_1 | -22.81 | 29635 |
| 271 | CTCCAACATAGATCCTC | 3-11-3 | CTCcaacatagatcCTC | 271_1 | -22.81 | 29636 |
| 272 | TCCAACATAGATCCTC | 2-10-4 | TCcaacatagatCCTC | 272_1 | -21.69 | 29636 |
| 273 | CTCCAACATAGATCCT | 3-10-3 | CTCcaacatagatCCT | 273_1 | -22.68 | 29637 |
| 274 | TCTCCAACATAGATCCT | 4-11-2 | TCTCcaacatagatcCT | 274_1 | -22.81 | 29637 |
| 275 | ATTCTCAATTGCACTT | 4-10-2 | ATTCtcaattgcacTT | 275_1 | -17.90 | 29661 |
| 276 | TATTCTCAATTGCACTT | 4-11-2 | TATTctcaattgcacTT | 276_1 | -18.54 | 29661 |
| 277 | TCACCTAATAGCACCA | 2-10-4 | TCacctaatagcACCA | 277_1 | -21.99 | 29684 |
| 278 | TTCACCTAATAGCACCA | 2-11-4 | TTcacctaatagcACCA | 278_1 | -22.53 | 29684 |
| 279 | CATTATTATTTAACCTT | 2-11-4 | CAttattatttaaCCTT | 279_1 | -17.83 | 30455 |
| 280 | ACATTATTATTTAACCT | 3-11-3 | ACAttattatttaaCCT | 280_1 | -18.05 | 30456 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 281 | TACATTATTATTTAACC | 4-11-2 | TACattattatttaaCC | 281_1 | −16.80 | 30457 |
| 282 | CATTTACATTATTATTTAAC | 2-14-4 | CAtttacattattattTAAC | 282_1 | −16.44 | 30458 |
| 283 | CTCATTTACATTATTATT | 4-12-2 | CTCAtttacattattaTT | 283_1 | −17.33 | 30462 |
| 284 | TATCTCATTTACATTATT | 4-12-2 | TATCtcatttacattaTT | 284_1 | −17.62 | 30465 |
| 285 | ATCATTCTCAACAATTA | 4-11-2 | ATCAttctcaacaatTA | 285_1 | −17.04 | 30601 |
| 285 | ATCATTCTCAACAATTA | 4-7-6 | ATCAttctcaaCAATTA | 285_2 | −21.48 | 30601 |
| 285 | ATCATTCTCAACAATTA | 1-1-3-6-6 | AtCATtctcaaCAATTA | 285_3 | −20.80 | 30601 |
| 285 | ATCATTCTCAACAATTA | 5-6-2-2-2 | ATCATtctcaaCAatTA | 285_4 | −20.46 | 30601 |
| 285 | ATCATTCTCAACAATTA | 4-7-1-1-4 | ATCAttctcaaCaATTA | 285_5 | −19.80 | 30601 |
| 285 | ATCATTCTCAACAATTA | 5-7-1-1-3 | ATCATtctcaacAaTTA | 285_6 | −19.31 | 30601 |
| 285 | ATCATTCTCAACAATTA | 5-6-3-1-2 | ATCATtctcaaCAAtTA | 285_7 | −20.97 | 30601 |
| 285 | ATCATTCTCAACAATTA | 4-7-2-1-3 | ATCAttctcaaCAaTTA | 285_8 | −20.16 | 30601 |
| 285 | ATCATTCTCAACAATTA | 5-6-1-1-4 | ATCATtctcaaCaATTA | 285_9 | −21.05 | 30601 |
| 285 | ATCATTCTCAACAATTA | 5-6-1-1-1-1-2 | ATCATtctcaaCaAtTA | 285_10 | −19.29 | 30601 |
| 285 | ATCATTCTCAACAATTA | 1-1-3-7-5 | AtCATtctcaacAATTA | 285_11 | −18.70 | 30601 |
| 286 | AAGATCATTCTCAACA | 4-10-2 | AAGAtcattctcaaCA | 286_1 | −17.15 | 30605 |
| 287 | TCTCAAAGATCATTCTC | 3-11-3 | TCTcaaagatcattCTC | 287_1 | −19.02 | 30609 |
| 288 | TCTCAAAGATCATTCT | 4-10-2 | TCTCaaagatcattCT | 288_1 | −17.81 | 30610 |
| 289 | ACTTAATTATACTTCC | 4-10-2 | ACTTaattatacttCC | 289_1 | −17.28 | 30667 |
| 290 | TACACTTAATTATACTTC | 2-12-4 | TAcacttaattataCTTC | 290_1 | −16.87 | 30668 |
| 291 | TTACACTTAATTATACTT | 3-12-3 | TTAcacttaattataCTT | 291_1 | −16.20 | 30669 |
| 292 | TTTACACTTAATTATACT | 2-12-4 | TTtacacttaattaTACT | 292_1 | −16.23 | 30670 |
| 293 | CTATTTAATTTACACTT | 3-11-3 | CTAtttaatttacaCTT | 293_1 | −16.26 | 30679 |
| 294 | TATCTATTTAATTTACAC | 3-12-3 | TATctatttaatttaCAC | 294_1 | −16.06 | 30681 |
| 295 | TTTATCTATTTAATTTACA | 4-13-2 | TTTAtctatttaatttaCA | 295_1 | −16.34 | 30682 |
| 296 | CTCTGCTTATAACTTT | 4-10-2 | CTCTgcttataactTT | 296_1 | −18.51 | 30699 |
| 297 | CCTCTGCTTATAACTT | 3-10-3 | CCTctgcttataaCTT | 297_1 | −21.29 | 30700 |
| 298 | TCCTCTGCTTATAACTT | 3-12-2 | TCCtctgcttataacTT | 298_1 | −20.86 | 30700 |
| 299 | TCCTCTGCTTATAACT | 3-11-2 | TCCtctgcttataaCT | 299_1 | −20.70 | 30701 |
| 300 | TTCCTCTGCTTATAACT | 3-12-2 | TTCctctgcttataaCT | 300_1 | −20.03 | 30701 |
| 301 | TTTCCTCTGCTTATAAC | 4-11-2 | TTTCctctgcttataAC | 301_1 | −19.20 | 30702 |
| 302 | TACTATACTTTCCTCT | 2-10-4 | TActatactttcCTCT | 302_1 | −20.07 | 30711 |
| 303 | TTCTACTATACTTTCC | 4-10-2 | TTCTactatactttCC | 303_1 | −19.55 | 30714 |
| 304 | AGTTCTACTATACTTTC | 4-11-2 | AGTTctactatactttTC | 304_1 | −18.49 | 30715 |
| 304 | AGTTCTACTATACTTTC | 1-10-6 | AgttctactatACTTTC | 304_2 | −18.76 | 30715 |

TABLE 3-continued

List of oligonucleotides or contiguous nucleobase sequences complementary to SEQ
ID NO: 1 (motif sequences indicated by SEQ ID NO), oligonucleotide designs made from these,
as well as specific oligonucleotide compounds (indicated by CMP ID NO) designed based on
the motif sequence.

| Seq ID NO | Motif | Design | Compound | CMP ID NO | ΔG° | Start SEQ ID NO 1 |
|---|---|---|---|---|---|---|
| 304 | AGTTCTACTATACTTTC | 1-1-2-7-1-1-4 | AgTTctactatAcTTTC | 304_3 | -18.23 | 30715 |
| 304 | AGTTCTACTATACTTTC | 3-8-2-2-2 | AGTtctactatACttTC | 304_4 | -19.19 | 30715 |
| 304 | AGTTCTACTATACTTTC | 2-2-1-6-1-1-4 | AGttCtactatAcTTTC | 304_5 | -19.07 | 30715 |
| 304 | AGTTCTACTATACTTTC | 1-2-2-8-4 | AgtTCtactatacTTTC | 304_6 | -18.46 | 30715 |
| 304 | AGTTCTACTATACTTTC | 3-10-1-1-2 | AGTtctactatacTtTC | 304_7 | -18.12 | 30715 |
| 304 | AGTTCTACTATACTTTC | 3-11-3 | AGTtctactatactTTC | 304_8 | -18.42 | 30715 |
| 304 | AGTTCTACTATACTTTC | 3-1-1-10-2 | AGTcCtactatactTTC | 304_9 | -18.58 | 30715 |
| 304 | AGTTCTACTATACTTTC | 2-1-2-10-2 | AGtTCtactatactTTC | 304_10 | -18.02 | 30715 |
| 304 | AGTTCTACTATACTTTC | 1-2-2-6-2-1-3 | AgtTCtactatACtTTC | 304_11 | -19.02 | 30715 |
| 304 | AGTTCTACTATACTTTC | 2-1-2-6-1-3-2 | AGtTCtactatActtTC | 304_12 | -18.22 | 30715 |
| 304 | AGTTCTACTATACTTTC | 2-2-1-7-2-1-2 | AGttCtactataCTtTC | 304_13 | -19.22 | 30715 |
| 304 | AGTTCTACTATACTTTC | 3-1-1-7-1-1-3 | AGTcCtactataCtTTC | 304_14 | -20.39 | 30715 |
| 304 | AGTTCTACTATACTTTC | 1-1-1-1-1-8-4 | AgTcCtactatacTTTC | 304_15 | -18.13 | 30715 |
| 305 | GTTCTACTATACTTTC | 4-10-2 | GTTCtactatactttTC | 305_1 | -17.48 | 30715 |
| 306 | CATTATATTTAAACTATCA | 4-13-2 | CATTatatttaaactatCA | 306_1 | -16.93 | 31630 |
| 307 | CACATTATATTTAAACTAT | 2-13-4 | CAcattatatttaaaCTAT | 307_1 | -17.11 | 31632 |
| 308 | ACACATTATATTTAAACTA | 3-13-3 | ACAcattatatttaaaCTA | 308_1 | -17.09 | 31633 |
| 309 | ACCACCTAAGACCTCAA | 2-11-4 | ACcacctaagaccTCAA | 309_1 | -22.49 | 32755 |
| 310 | CCACCTAAGACCTCAA | 2-10-4 | CCacctaagaccTCAA | 310_1 | -22.63 | 32755 |
| 311 | ACCACCTAAGACCTCA | 2-11-3 | ACcacctaagaccTCA | 311_1 | -21.74 | 32756 |
| 312 | ACCTTAAGTAACATTT | 4-10-2 | ACCTtaagtaacatTT | 312_1 | -16.82 | 33366 |
| 313 | CACCTTAAGTAACATT | 4-10-2 | CACCttaagtaacaTT | 313_1 | -18.05 | 33367 |
| 314 | CCACCTTAAGTAACAT | 3-10-3 | CCAccttaagtaaCAT | 314_1 | -20.70 | 33368 |
| 315 | ACCACCTTAAGTAACA | 4-10-2 | ACCAccttaagtaaCA | 315_1 | -20.68 | 33369 |
| 316 | TTATTAACCACCTTAA | 3-10-3 | TTAttaaccacctTAA | 316_1 | -16.19 | 33375 |
| 317 | CATTATTAACCACCTT | 2-10-4 | CAttattaaccaCCTT | 317_1 | -19.92 | 33377 |
| 318 | ACATTATTAACCACCT | 3-10-3 | ACAttattaaccaCCT | 318_1 | -20.14 | 33378 |
| 319 | ACCAATTATACTTACAA | 3-11-3 | ACCaattatacttaCAA | 319_1 | -17.16 | 36606 |
| 320 | AACCAATTATACTTACA | 4-11-2 | AACCaattatacttaCA | 320_1 | -17.16 | 36607 |
| 321 | CAAATACAGATTATCC | 2-10-4 | CAaatacagattATCC | 321_1 | -16.44 | 38092 |
| 322 | TTTACATTCCCATCATC | 2-11-4 | TTtacattcccatCATC | 322_1 | -21.08 | 38297 |
| 323 | CACACCTATTATATAAT | 4-11-2 | CACAcctattatataAT | 323_1 | -17.02 | 39173 |
| 324 | TCACACCTATTATATAA | 3-11-3 | TCAcacctattataTAA | 324_1 | -17.02 | 39174 |
| 325 | CTTCACACCTATTATATA | 2-12-4 | CTtcacacctattaTATA | 325_1 | -20.65 | 39175 |
| 326 | ACTTCACACCTATTATAT | 3-12-3 | ACTtcacacctattaTAT | 326_1 | -20.46 | 39176 |
| 327 | GCTCACACTAATTATT | 2-10-4 | GCtcacactaatTATT | 327_1 | -18.72 | 39228 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 328 | ATGCTCACACTAATTA | 4-10-2 | ATGCtcacactaatTA | 328_1 | -19.38 | 39230 |
| 329 | AATGCTCACACTAATT | 4-10-2 | AATGctcacactaaTT | 329_1 | -16.21 | 39231 |
| 330 | AAACTGTACACCTACT | 2-10-4 | AAactgtacaccTACT | 330_1 | -17.99 | 39563 |
| 331 | GTTTCCATCTACTATTA | 2-11-4 | GTttccatctactATTA | 331_1 | -19.78 | 39808 |
| 332 | TTTCCATCTACTATTA | 4-10-2 | TTTCcatctactatTA | 332_1 | -17.25 | 39808 |
| 333 | TGACATAACCATATAC | 3-10-3 | TGAcataaccataTAC | 333_1 | -16.63 | 39931 |
| 334 | GCTCCCAAACAACTAA | 2-12-2 | GCtcccaaacaactAA | 334_1 | -17.55 | 41114 |
| 335 | CCTCAATACTCTACTT | 4-10-2 | CCTCaatactctacTT | 335_1 | -20.30 | 41444 |
| 336 | GACCTCAATACTCTACT | 3-11-3 | GACctcaatactctACT | 336_1 | -21.01 | 41445 |
| 337 | GACCTCAATACTCTAC | 4-10-2 | GACCtcaatactctAC | 337_1 | -20.02 | 41446 |
| 338 | TACTAAACATACACATA | 4-11-2 | TACTaaacatacacaTA | 338_1 | -16.12 | 41725 |
| 339 | CTACTAAACATACACAT | 3-11-3 | CTActaaacatacaCAT | 339_1 | -17.31 | 41726 |
| 340 | TTCTACTAAACATACAC | 3-11-3 | TTCtactaaacataCAC | 340_1 | -16.07 | 41728 |
| 341 | TACCAATAGTTACCTT | 2-10-4 | TAccaatagttaCCTT | 341_1 | -20.03 | 42167 |
| 342 | CTTACCAATAGTTACCT | 3-11-3 | CTTaccaatagttaCCT | 342_1 | -22.29 | 42168 |
| 343 | TTACCAATAGTTACCT | 3-10-3 | TTAccaatagttaCCT | 343_1 | -20.03 | 42168 |
| 344 | CTTACCAATAGTTACC | 4-10-2 | CTTAccaatagttaCC | 344_1 | -20.03 | 42169 |
| 345 | TCTTACCAATAGTTACC | 4-11-2 | TCTTaccaatagttaCC | 345_1 | -21.30 | 42169 |
| 346 | TCAAAGCACACCACCAC | 2-12-3 | TCaaagcacaccacCAC | 346_1 | -21.69 | 42287 |
| 347 | ATTCAAAGCACACCACC | 2-12-3 | ATtcaaagcacaccACC | 347_1 | -21.00 | 42289 |
| 348 | AGACTAATCCTCTTAA | 3-10-3 | AGActaatcctctTAA | 348_1 | -17.72 | 43452 |
| 349 | TAGACTAATCCTCTTA | 4-10-2 | TAGActaatcctctTA | 349_1 | -19.20 | 43453 |
| 350 | CCCATTTCTAACATTTAC | 3-12-3 | CCCatttctaacattTAC | 350_1 | -22.93 | 43562 |
| 351 | ACCCATTTCTAACATT | 4-10-2 | ACCCatttctaacaTT | 351_1 | -20.64 | 43565 |
| 352 | AACCCATTTCTAACAT | 4-10-2 | AACCcatttctaacAT | 352_1 | -18.25 | 43566 |
| 353 | CCTCAACTTCACCAAT | 2-10-4 | CCtcaacttcacCAAT | 353_1 | -21.73 | 43634 |
| 354 | ACTGATTTCCTTAAAC | 4-10-2 | ACTGatttccttaaAC | 354_1 | -16.67 | 44180 |
| 355 | CACTGATTTCCTTAAAC | 4-11-2 | CACTgatttccttaaAC | 355_1 | -18.91 | 44180 |
| 356 | CCACTGATTTCCTTAAA | 4-11-2 | CCACtgatttccttaAA | 356_1 | -20.91 | 44181 |
| 357 | ACCACTGATTTCCTTA | 2-10-4 | ACcactgatttcCTTA | 357_1 | -20.98 | 44183 |
| 358 | CACCACTGATTTCCTT | 3-10-3 | CACcactgatttcCTT | 358_1 | -22.04 | 44184 |
| 359 | CTCTGCAATACACCAA | 2-10-4 | CTctgcaatacaCCAA | 359_1 | -20.90 | 44439 |
| 360 | ACTCTGCAATACACCA | 3-10-3 | ACTctgcaatacaCCA | 360_1 | -22.19 | 44440 |
| 361 | TACTCTGCAATACACCA | 2-11-4 | TActctgcaatacACCA | 361_1 | -22.32 | 44440 |
| 361 | TACTCTGCAATACACCA | 1-1-1-10-1-1-2 | TaCtctgcaatacAcCA | 361_2 | -19.29 | 44440 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 361 | TACTCTGCAATACACCA | 1-3-1-8-1-1-2 | TactCtgcaatacAcCA | 361_3 | -19.28 | 44440 |
| 361 | TACTCTGCAATACACCA | 1-10-1-3-2 | TactctgcaatAcacCA | 361_4 | -18.35 | 44440 |
| 361 | TACTCTGCAATACACCA | 2-10-2-1-2 | TActctgcaataCAcCA | 361_5 | -21.63 | 44440 |
| 361 | TACTCTGCAATACACCA | 1-13-3 | TactctgcaatacaCCA | 361_6 | -20.54 | 44440 |
| 361 | TACTCTGCAATACACCA | 2-10-1-2-2 | TActctgcaataCacCA | 361_7 | -20.06 | 44440 |
| 361 | TACTCTGCAATACACCA | 1-1-1-12-2 | TaCtctgcaatacacCA | 361_8 | -19.14 | 44440 |
| 361 | TACTCTGCAATACACCA | 1-2-2-10-2 | TacTCtgcaatacacCA | 361_9 | -20.33 | 44440 |
| 361 | TACTCTGCAATACACCA | 1-3-1-10-2 | TactCtgcaatacacCA | 361_10 | -19.13 | 44440 |
| 362 | TACTCTGCAATACACC | 2-10-4 | TActctgcaataCACC | 362_1 | -21.12 | 44441 |
| 362 | TACTCTGCAATACACC | 1-1-1-11-2 | TaCtctgcaatacaCC | 362_2 | -18.23 | 44441 |
| 362 | TACTCTGCAATACACC | 1-1-1-10-3 | TaCtctgcaatacACC | 362_3 | -18.78 | 44441 |
| 362 | TACTCTGCAATACACC | 1-3-1-7-4 | TactCtgcaataCACC | 362_4 | -20.87 | 44441 |
| 362 | TACTCTGCAATACACC | 3-11-2 | TACtctgcaatacaCC | 362_5 | -19.86 | 44441 |
| 362 | TACTCTGCAATACACC | 2-2-1-9-2 | TActCtgcaatacaCC | 362_6 | -19.44 | 44441 |
| 362 | TACTCTGCAATACACC | 2-12-2 | TActctgcaatacaCC | 362_7 | -18.47 | 44441 |
| 362 | TACTCTGCAATACACC | 1-2-2-9-2 | TacTCtgcaatacaCC | 362_8 | -19.42 | 44441 |
| 362 | TACTCTGCAATACACC | 2-1-2-9-2 | TAcTCtgcaatacaCC | 362_9 | -20.64 | 44441 |
| 362 | TACTCTGCAATACACC | 1-3-1-9-2 | TactCtgcaatacaCC | 362_10 | -18.22 | 44441 |
| 363 | TTACTCTGCAATACACC | 2-11-4 | TTactctgcaataCACC | 363_1 | -21.71 | 44441 |
| 364 | TTACTCTGCAATACAC | 3-10-3 | TTActctgcaataCAC | 364_1 | -17.75 | 44442 |
| 365 | TTTACTCTGCAATACAC | 3-11-3 | TTTactctgcaataCAC | 365_1 | -18.34 | 44442 |
| 366 | CTTTACTCTGCAATACA | 2-11-4 | CTttactctgcaaTACA | 366_1 | -20.23 | 44443 |
| 367 | TTTACTCTGCAATACA | 2-10-4 | TTtactctgcaaTACA | 367_1 | -17.56 | 44443 |
| 368 | GACCACACTTTCTACCA | 2-13-2 | GAccacactttctacCA | 368_1 | -21.72 | 44477 |
| 369 | GACCACACTTTCTACC | 2-12-2 | GAccacactttctaCC | 369_1 | -20.81 | 44478 |
| 370 | AAGAAACACCCTTCCA | 2-10-4 | AAgaaacaccctTCCA | 370_1 | -21.48 | 44776 |
| 371 | ATCTGCTACATATTCTT | 4-11-2 | ATCTgctacatattcTT | 371_1 | -19.88 | 45216 |
| 372 | ATCTGCTACATATTCT | 4-10-2 | ATCTgctacatattCT | 372_1 | -19.71 | 45217 |
| 373 | CATCTGCTACATATTCT | 4-11-2 | CATCtgctacatattCT | 373_1 | -21.32 | 45217 |
| 374 | CATCTGCTACATATTC | 4-10-2 | CATCtgctacatatTC | 374_1 | -18.82 | 45218 |
| 375 | TTCAACCCTAATCACT | 4-10-2 | TTCAaccctaatcaCT | 375_1 | -19.99 | 45246 |
| 376 | ATTCAACCCTAATCAC | 2-10-4 | ATtcaaccctaaTCAC | 376_1 | -18.67 | 45247 |
| 377 | CATTCAACCCTAATCA | 3-10-3 | CATtcaaccctaaTCA | 377_1 | -19.93 | 45248 |
| 378 | GCATTCAACCCTAATCA | 3-12-2 | GCAttcaaccctaatCA | 378_1 | -22.56 | 45248 |
| 379 | AGCATTCAACCCTAATC | 4-11-2 | AGCAttcaaccctaaTC | 379_1 | -22.98 | 45249 |
| 380 | GCATTCAACCCTAATC | 4-10-2 | GCATtcaaccctaaTC | 380_1 | -21.63 | 45249 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 381 | AGCATTCAACCCTAAT | 4-10-2 | AGCAttcaaccctaAT | 381_1 | -21.62 | 45250 |
| 382 | CAGCATTCAACCCTAAT | 3-12-2 | CAGcattcaaccctaAT | 382_1 | -21.12 | 45250 |
| 383 | TTAAATCCAGCATTCA | 3-10-3 | TTAaatccagcatTCA | 383_1 | -18.08 | 45258 |
| 384 | CTCCATATTTAAATCC | 4-10-2 | CTCCatatttaaatCC | 384_1 | -20.02 | 45266 |
| 385 | GCTCCATATTTAAATCC | 4-11-2 | GCTCcatatttaaatCC | 385_1 | -22.84 | 45266 |
| 386 | GCTCCATATTTAAATC | 4-10-2 | GCTCcatatttaaaTC | 386_1 | -18.78 | 45267 |
| 387 | AGCTCCATATTTAAAT | 4-10-2 | AGCTccatatttaaAT | 387_1 | -18.62 | 45268 |
| 388 | TAAGCTCCATATTTAA | 3-10-3 | TAAgctccatattTAA | 388_1 | -16.08 | 45270 |
| 389 | CCTAAGCTCCATATTTA | 3-11-3 | CCTaagctccatatTTA | 389_1 | -22.65 | 45271 |
| 390 | CTAAGCTCCATATTTA | 4-10-2 | CTAAgctccatattTA | 390_1 | -18.81 | 45271 |
| 391 | CCTAAGCTCCATATTT | 4-10-2 | CCTAagctccatatTT | 391_1 | -21.57 | 45272 |
| 392 | TCTACCCTAAATTCCC | 2-11-3 | TCtaccctaaattCCC | 392_1 | -23.00 | 45560 |
| 393 | CACATCTTGTATACAA | 3-10-3 | CACatcttgtataCAA | 393_1 | -16.65 | 45627 |
| 394 | ACACATCTTGTATACA | 4-10-2 | ACACatcttgtataCA | 394_1 | -17.95 | 45628 |
| 395 | CTACACATCTTGTATAC | 3-11-3 | CTAcacatcttgtaTAC | 395_1 | -19.13 | 45629 |
| 396 | TACACATCTTGTATAC | 3-10-3 | TACacatcttgtaTAC | 396_1 | -16.73 | 45629 |
| 397 | CTTGACTACACATCTT | 3-10-3 | CTTgactacacatCTT | 397_1 | -18.89 | 45635 |
| 398 | CTCTACAACAGTCCCA | 3-11-2 | CTCtacaacagtccCA | 398_1 | -22.06 | 45709 |
| 399 | TCTCTACAACAGTCCCA | 2-13-2 | TCtctacaacagtccCA | 399_1 | -21.70 | 45709 |
| 400 | ATAACATTACTCTTAACA | 3-12-3 | ATAacattactcttaACA | 400_1 | -17.03 | 46215 |
| 401 | TTTGACATTCCATCTCC | 2-12-3 | TTtgacattccatcTCC | 401_1 | -21.62 | 46256 |
| 402 | CTTTGACATTCCATCTC | 2-11-4 | CTttgacattccaTCTC | 402_1 | -21.88 | 46257 |
| 403 | TCTTTGACATTCCATCTC | 4-12-2 | TCTTtgacattccatcTC | 403_1 | -22.41 | 46257 |
| 404 | TTTGACATTCCATCTC | 3-10-3 | TTTgacattccatCTC | 404_1 | -19.40 | 46257 |
| 405 | ATCTTTGACATTCCATC | 2-11-4 | ATctttgacattcCATC | 405_1 | -20.53 | 46259 |
| 406 | TATCTTTGACATTCCAT | 2-11-4 | TAtctttgacattCCAT | 406_1 | -21.32 | 46260 |
| 407 | TACTATCTTTGACATTC | 4-11-2 | TACTatctttgacatTC | 407_1 | -18.39 | 46263 |
| 408 | TACTATCTTTGACATT | 4-10-2 | TACTatctttgacaTT | 408_1 | -16.84 | 46264 |
| 409 | CTGTATACACCATCCC | 2-12-2 | CTgtatacaccatcCC | 409_1 | -21.84 | 46392 |
| 410 | TCTGTATACACCATCC | 4-10-2 | TCTGtatacaccatCC | 410_1 | -22.73 | 46393 |
| 411 | TTTCTGACTCCCTATCC | 2-13-2 | TTtctgactccctatCC | 411_1 | -22.48 | 46420 |
| 412 | CCTATGTTAATACTTTC | 4-11-2 | CCTAtgttaatactttTC | 412_1 | -19.53 | 46505 |
| 413 | CTATGTTAATACTTTC | 4-10-2 | CTATgttaatactTTC | 413_1 | -16.09 | 46505 |
| 414 | CCTATGTTAATACTTT | 4-10-2 | CCTAtgttaatactTT | 414_1 | -17.85 | 46506 |
| 415 | TCCTATGTTAATACTT | 3-10-3 | TCCtatgttaataCTT | 415_1 | -18.47 | 46507 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 416 | ATCCTATGTTAATACT | 4-10-2 | ATCCtatgttaataCT | 416_1 | −18.71 | 46508 |
| 417 | ATTTCATTAAGTCACCC | 3-11-3 | ATTtcattaagtcaCCC | 417_1 | −22.16 | 47364 |
| 418 | ATTTCATTAAGTCACC | 2-10-4 | ATttcattaagtCACC | 418_1 | −18.79 | 47365 |
| 419 | CTCTCCTCAAGATCAAC | 3-11-3 | CTCtcctcaagatcAAC | 419_1 | −20.29 | 48110 |
| 420 | CTCTCCTCAAGATCAA | 3-10-3 | CTCtcctcaagatCAA | 420_1 | −20.33 | 48111 |
| 421 | CCATACAGTATATACA | 4-10-2 | CCATacagtatataCA | 421_1 | −19.53 | 48186 |
| 422 | CAACTATTATCTTCTT | 2-10-4 | CAactattatctTCTT | 422_1 | −16.38 | 48221 |
| 423 | ACAACTATTATCTTCT | 3-10-3 | ACAactattatctTCT | 423_1 | −16.60 | 48222 |
| 424 | TTGCTTCCAATTTATTT | 4-11-2 | TTGCttccaatttatTT | 424_1 | −19.93 | 50282 |
| 425 | ATCTCATGACCACCTAA | 3-11-3 | ATCtcatgaccaccTAA | 425_1 | −21.74 | 51241 |
| 425 | ATCTCATGACCACCTAA | 1-1-1-9-2-1-2 | AtCtcatgaccaCCTAA | 425_2 | −21.11 | 51241 |
| 425 | ATCTCATGACCACCTAA | 1-1-1-8-1-2-3 | AtCtcatgaccAccTAA | 425_3 | −19.96 | 51241 |
| 425 | ATCTCATGACCACCTAA | 1-12-4 | AtctcatgaccacCTAA | 425_4 | −20.40 | 51241 |
| 425 | ATCTCATGACCACCTAA | 3-10-1-1-2 | ATCtcatgaccacCTAA | 425_5 | −20.66 | 51241 |
| 425 | ATCTCATGACCACCTAA | 1-1-1-10-1-1-2 | AtCtcatgaccacCTAA | 425_6 | −18.72 | 51241 |
| 425 | ATCTCATGACCACCTAA | 1-1-1-9-1-1-3 | AtCtcatgaccaCcTAA | 425_7 | −20.59 | 51241 |
| 425 | ATCTCATGACCACCTAA | 1-2-2-7-1-1-3 | AtcTCatgaccaCcTAA | 425_8 | −21.48 | 51241 |
| 425 | ATCTCATGACCACCTAA | 1-3-1-8-4 | AtctCatgaccacCTAA | 425_9 | −21.07 | 51241 |
| 425 | ATCTCATGACCACCTAA | 1-1-3-8-1-1-2 | AtCTCatgaccacCtAA | 425_10 | −21.27 | 51241 |
| 426 | TCTCATGACCACCTAA | 2-10-4 | TCtcatgaccacCTAA | 426_1 | −21.25 | 51241 |
| 427 | ATCTCATGACCACCTA | 3-10-3 | ATCtcatgaccacCTA | 427_1 | −22.56 | 51242 |
| 428 | TATCTCATGACCACCTA | 2-12-3 | TAtctcatgaccacCTA | 428_1 | −21.88 | 51242 |
| 429 | TTTATCTCATGACCACC | 2-11-4 | TTtatctcatgacCACC | 429_1 | −22.37 | 51244 |
| 430 | TTTATCTCATGACCAC | 2-10-4 | TTtatctcatgaCCAC | 430_1 | −19.56 | 51245 |
| 431 | ATTCTTACCGTCTTTA | 4-10-2 | ATTCttaccgtcttTA | 431_1 | −19.52 | 51358 |
| 432 | TATTCTTACCGTCTTTA | 3-11-3 | TATtcttaccgtctTTA | 432_1 | −20.10 | 51358 |
| 433 | TATTCTTACCGTCTTT | 2-10-4 | TAttcttaccgtCTTT | 433_1 | −19.30 | 51359 |
| 434 | TTATTCTTACCGTCTTT | 2-11-4 | TTattcttaccgtCTTT | 434_1 | −19.99 | 51359 |
| 435 | ATCTGATCTCACACAT | 3-10-3 | ATCtgatctcacaCAT | 435_1 | −19.62 | 51438 |
| 436 | CATCTGATCTCACACAT | 4-11-2 | CATCtgatctcacacAT | 436_1 | −20.82 | 51438 |
| 437 | ACTTCCAGATTTCTACA | 2-11-4 | ACttccagatttcTACA | 437_1 | −21.44 | 51953 |
| 438 | TTTATGTTTACTTCAT | 3-10-3 | TTTatgtttacttCAT | 438_1 | −16.05 | 52150 |
| 439 | TAAAGATCCCATCACTC | 3-11-3 | TAAagatcccatcaCTC | 439_1 | −20.31 | 52549 |
| 440 | TAAAGATCCCATCACT | 4-10-2 | TAAAgatcccatcaCT | 440_1 | −18.82 | 52550 |
| 441 | CCTAAAGATCCCATCAC | 2-12-3 | CCtaaagatcccatCAC | 441_1 | −22.32 | 52551 |
| 442 | ATCATCAGTTACATCA | 4-10-2 | ATCAtcagttacatCA | 442_1 | −18.64 | 52579 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 443 | ACTCTCACTGTAACTTT | 4-11-2 | ACTCtcactgtaactTT | 443_1 | -19.76 | 53012 |
| 444 | AACTCTCACTGTAACTT | 3-11-3 | AACtctcactgtaaCTT | 444_1 | -18.53 | 53013 |
| 445 | ACTCTCACTGTAACTT | 3-10-3 | ACTctcactgtaaCTT | 445_1 | -19.04 | 53013 |
| 446 | AACTCTCACTGTAACT | 4-10-2 | AACTctcactgtaaCT | 446_1 | -17.97 | 53014 |
| 447 | CAACTCTCACTGTAACT | 4-11-2 | CAACtctcactgtaaCT | 447_1 | -20.01 | 53014 |
| 448 | CCTTTCATTAACATTTA | 3-11-3 | CCTttcattaacatTTA | 448_1 | -19.03 | 54198 |
| 449 | TTCCTTTCATTAACATTT | 4-12-2 | TTCCtttcattaacatTT | 449_1 | -19.92 | 54199 |
| 450 | TAATCCTATTCCAACT | 3-10-3 | TAAtcctattccaACT | 450_1 | -18.05 | 54232 |
| 451 | CTAATCCTATTCCAAC | 2-10-4 | CTaatcctattcCAAC | 451_1 | -18.65 | 54233 |
| 452 | CTCTAATCCTATTCCA | 3-10-3 | CTCtaatcctattCCA | 452_1 | -22.58 | 54235 |
| 453 | TCTCTAATCCTATTCC | 4-10-2 | TCTCtaatcctattCC | 453_1 | -21.78 | 54236 |
| 454 | TTGTCTCTAATCCTATT | 2-11-4 | TTgtctctaatccTATT | 454_1 | -19.70 | 54238 |
| 455 | TTGTCTCTAATCCTAT | 2-10-4 | TTgtctctaatcCTAT | 455_1 | -19.45 | 54239 |
| 456 | TCTTTAAGCTTCCCAC | 2-10-4 | TCtttaagcttcCCAC | 456_1 | -22.96 | 54609 |
| 457 | AAACTACCCTGCACAA | 3-10-3 | AAActaccctgcaCAA | 457_1 | -18.41 | 54924 |
| 458 | CCATGCTACATAAACC | 4-10-2 | CCATgctacataaaCC | 458_1 | -22.25 | 55337 |
| 459 | TCCATGCTACATAAAC | 4-10-2 | TCCAtgctacataaAC | 459_1 | -18.64 | 55338 |
| 460 | ACTCCTAAGAATTACA | 4-10-2 | ACTCctaagaattaCA | 460_1 | -17.62 | 59565 |
| 461 | GAAACTATTACTCCTA | 2-10-4 | GAaactattactCCTA | 461_1 | -19.06 | 59574 |
| 462 | TGAAACTATTACTCCT | 3-10-3 | TGAaactattactCCT | 462_1 | -19.30 | 59575 |
| 463 | ATGAAACTATTACTCC | 2-10-4 | ATgaaactattaCTCC | 463_1 | -17.96 | 59576 |
| 464 | AACAACTCATGCCACA | 2-10-4 | AAcaactcatgcCACA | 464_1 | -19.72 | 60012 |
| 465 | AAATATTGCCACCATT | 2-10-4 | AAatattgccacCATT | 465_1 | -17.78 | 60298 |
| 466 | GTTACATATTCTTTCAC | 3-11-3 | GTTacatattctttCAC | 466_1 | -18.76 | 60448 |
| 467 | TCATACTTGCTTTAAT | 4-10-2 | TCATacttgctttaAT | 467_1 | -17.29 | 60821 |
| 468 | ATCCTGATAATTAACT | 4-10-2 | ATCCtgataattaaCT | 468_1 | -17.73 | 61925 |
| 469 | CCTTAATCTGTATCAC | 3-10-3 | CCTtaatctgtatCAC | 469_1 | -19.92 | 62287 |
| 470 | ATACACAGCACATATT | 2-10-4 | ATacacagcacaTATT | 470_1 | -17.58 | 62422 |
| 471 | TCAGAATAATTCTCCT | 3-10-3 | TCAgaataattctCCT | 471_1 | -19.81 | 62443 |
| 472 | TCTTCAGCTTTCTAAAT | 4-11-2 | TCTTcagctttctaaAT | 472_1 | -18.58 | 64113 |
| 473 | AGTCCTTCCTTTAACCA | 2-13-2 | AGtccttcctttaacCA | 473_1 | -22.20 | 64461 |
| 474 | TAGTCCTTCCTTTAACC | 2-13-2 | TAgtccttcctttaaCC | 474_1 | -22.12 | 64462 |
| 475 | TTTAACCTTGCTTATA | 2-10-4 | TTtaaccttgctTATA | 475_1 | -17.50 | 65272 |
| 476 | ATCCCTTTGTAATCAT | 4-10-2 | ATCCctttgtaatcAT | 476_1 | -20.31 | 66840 |
| 477 | CTTGCATTTCTAATTAC | 3-11-3 | CTTgcatttctaatTAC | 477_1 | -18.09 | 67426 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 478 | CTTGTCAAATCATTTCT | 4-11-2 | CTTGtcaaatcatttCT | 478_1 | -19.10 | 68194 |
| 479 | CCATCTAATGATTATT | 4-10-2 | CCATctaatgattaTT | 479_1 | -17.28 | 68328 |
| 480 | TATCAGTTATCCAATA | 4-10-2 | TATCagttatccaaTA | 480_1 | -17.39 | 68805 |
| 481 | TCACTGCCATCAATAC | 4-10-2 | TCACtgccatcaatAC | 481_1 | -19.71 | 68921 |
| 482 | TGTCATCTACAAATCA | 4-10-2 | TGTCatctacaaatCA | 482_1 | -18.01 | 70133 |
| 483 | CTCTTTAGATTCATCC | 4-10-2 | CTCTttagattcatCC | 483_1 | -20.94 | 72377 |
| 484 | ACTCTTTAGATTCATC | 2-10-4 | ACtctttagattCATC | 484_1 | -17.81 | 72378 |
| 485 | CAACTCTATGACTACC | 2-10-4 | CAactctatgacTACC | 485_1 | -20.07 | 72826 |
| 486 | ACCTGTAATACTTCTT | 4-10-2 | ACCTgtaatacttcTT | 486_1 | -19.67 | 72861 |
| 487 | GAATTCTTTATTCCTCC | 2-11-4 | GAattctttattcCTCC | 487_1 | -22.53 | 72887 |
| 488 | ATCTGAATCAAACCTT | 2-10-4 | ATctgaatcaaaCCTT | 488_1 | -17.97 | 73474 |
| 489 | ACTTTACTGCCATAATC | 3-11-3 | ACTttactgccataATC | 489_1 | -19.60 | 73992 |
| 490 | TTACTCTTAGCAACCT | 4-10-2 | TTACtcttagcaacCT | 490_1 | -20.19 | 74791 |
| 491 | CACCAGTATTTCTTCTT | 4-11-2 | CACCagtatttcttcTT | 491_1 | -22.15 | 74851 |
| 492 | TTCACCAGTATTTCTTC | 4-11-2 | TTCAccagtatttctTC | 492_1 | -20.43 | 74853 |
| 493 | CCAAATAAGCAAACTC | 3-10-3 | CCAaataagcaaaCTC | 493_1 | -17.54 | 75840 |
| 494 | CCCAAATAAGCAAACT | 4-10-2 | CCCAaataagcaaaCT | 494_1 | -20.23 | 75841 |
| 495 | GACTACATTCTCAATA | 3-10-3 | GACtacattctcaATA | 495_1 | -17.49 | 76238 |
| 496 | TTGTCAATCTTTATTCT | 4-11-2 | TTGTcaatctttattCT | 496_1 | -18.85 | 76254 |
| 497 | AGCTTACCAAATATTC | 4-10-2 | AGCTtaccaaatatTC | 497_1 | -18.68 | 76811 |
| 498 | TTACACATGTATATCC | 3-10-3 | TTAcacatgtataTCC | 498_1 | -18.23 | 77114 |
| 499 | ATCCTGTTAATACCAT | 2-10-4 | ATcctgttaataCCAT | 499_1 | -20.41 | 80468 |
| 500 | TTCTTAGTCACACACA | 4-10-2 | TTCTtagtcacacaCA | 500_1 | -19.37 | 81047 |
| 501 | TTCTGTTTCCATTTACA | 4-11-2 | TTCTgtttccatttaCA | 501_1 | -21.31 | 82233 |
| 502 | TCTATATCAAGTTCCTT | 2-11-4 | TCtatatcaagttCCTT | 502_1 | -20.95 | 84166 |
| 503 | ATTCAGTTACCAACTA | 3-10-3 | ATTcagttaccaACTA | 503_1 | -18.37 | 85392 |
| 504 | GCTTCTACTTAAATAT | 3-10-3 | GCTtctacttaaaTAT | 504_1 | -17.58 | 86974 |
| 505 | CCCTCAAAGTAATTTC | 4-10-2 | CCCTcaaagtaattTC | 505_1 | -20.53 | 87728 |
| 506 | AACATGTAATTTCCAT | 2-10-4 | AAcatgtaatttCCAT | 506_1 | -17.21 | 87810 |
| 507 | CCAGACTCCAATATTT | 4-10-2 | CCAGactccaatatTT | 507_1 | -20.78 | 88417 |
| 508 | CTTAGACTTCACCTTTC | 2-11-4 | CTtagacttcaccTTTC | 508_1 | -20.56 | 88991 |
| 509 | CTGCTTAATTATATCA | 4-10-2 | CTGCttaattatatCA | 509_1 | -18.85 | 90228 |
| 510 | AAATTGTCTACCTTCCT | 2-12-3 | AAattgtctaccttCCT | 510_1 | -20.62 | 90474 |
| 511 | CACTTAGAATATCCCT | 2-10-4 | CActtagaatatCCCT | 511_1 | -22.28 | 91625 |
| 512 | ATCCAAAGTTTCTTTC | 4-10-2 | ATCCaaagtttcttTC | 512_1 | -18.64 | 91885 |
| 513 | ATATTTGTCACCTAAC | 4-10-2 | ATATttgtcacctaAC | 513_1 | -17.12 | 92976 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 514 | CTATTCTCAGTATTAT | 3-10-3 | CTAttctcagtatTAT | 514_1 | -17.42 | 94304 |
| 515 | CCATTCAATGATCACT | 2-10-4 | CCattcaatgatCACT | 515_1 | -20.55 | 94528 |
| 516 | CACTAGTACTCTTATT | 4-10-2 | CACTagtactcttaTT | 516_1 | -18.01 | 95653 |
| 517 | GCCACAACATCTATTT | 4-10-2 | GCCAcaacatctatTT | 517_1 | -21.53 | 96751 |
| 518 | AGCACATATACCATCA | 4-10-2 | AGCAcatataccatCA | 518_1 | -21.98 | 97636 |
| 519 | GTCATCTAACTTCTTAC | 3-11-3 | GTCatctaacttctTAC | 519_1 | -19.25 | 98480 |
| 520 | TGTCATCTAACTTCTTA | 4-11-2 | TGTCatctaacttctTA | 520_1 | -19.69 | 98481 |
| 521 | CCCTTATAGTTATTAA | 3-10-3 | CCCttatagttatTAA | 521_1 | -19.32 | 99646 |
| 522 | TCCATAGAATTCTTCA | 4-10-2 | TCCAtagaattcttCA | 522_1 | -19.92 | 100334 |
| 523 | TTGATTCCACCATTAA | 3-10-3 | TTGattccaccatTAA | 523_1 | -18.05 | 101110 |
| 524 | CAGCCATAAACTATAT | 4-10-2 | CAGCcataaactatAT | 524_1 | -18.60 | 101898 |
| 525 | TATGACTTATTCCATA | 2-10-4 | TAtgacttattcCATA | 525_1 | -17.88 | 102558 |
| 526 | GTTAACCTATATTTCA | 4-10-2 | GTTAacctatatttCA | 526_1 | -17.69 | 103589 |
| 527 | TGTCTATTCTCTTCATT | 4-11-2 | TGTCtattctcttcaTT | 527_1 | -20.62 | 104309 |
| 528 | TTACTCTTTGATTTCAT | 3-11-3 | TTActctttgatttCAT | 528_1 | -18.39 | 105686 |
| 529 | GATAATTCCAAATCCC | 2-10-4 | GAtaattccaaaTCCC | 529_1 | -20.99 | 107972 |
| 530 | TCTTATCCTTGAATTTC | 4-11-2 | TCTTatccttgaattTC | 530_1 | -18.85 | 108257 |
| 531 | ATATCCCTTGATTATCC | 3-11-3 | ATAtcccttgattaTCC | 531_1 | -22.75 | 109407 |
| 532 | TTAGTATACCCTTTAT | 3-10-3 | TTAgtataccctttTAT | 532_1 | -18.67 | 110210 |
| 533 | CTCTTTGTCAAATACT | 4-10-2 | CTCTttgtcaaataCT | 533_1 | -18.16 | 110768 |
| 534 | CCAAACTGTCTTCTAAT | 2-11-4 | CCaaactgtcttcTAAT | 534_1 | -19.87 | 111811 |
| 535 | TCCAAACTGTCTTCTAA | 3-12-2 | TCCaaactgtcttctAA | 535_1 | -18.33 | 111812 |
| 536 | CCAGCATATTATATAC | 3-10-3 | CCAgcatattataTAC | 536_1 | -18.96 | 112149 |
| 537 | TCCAGCATATTATATA | 4-10-2 | TCCAgcatattataTA | 537_1 | -19.41 | 112150 |
| 538 | TCATTGAACAACTCTTC | 4-11-2 | TCATtgaacaactctTC | 538_1 | -18.01 | 112945 |
| 539 | CTGCCATCTTTATTTAT | 4-11-2 | CTGCcatctttatttAT | 539_1 | -21.89 | 113533 |
| 540 | TGAAACATTCTTCCCAC | 2-12-3 | TGaaacattcttccCAC | 540_1 | -19.76 | 114274 |
| 541 | TTTATTAGATTACTCC | 2-10-4 | TTtattagattaCTCC | 541_1 | -17.38 | 114495 |
| 542 | TTCCAGCTTATTTACCT | 3-12-2 | TTCcagcttatttacCT | 542_1 | -21.28 | 114831 |
| 543 | AGCATCATATAAACCT | 3-10-3 | AGCatcatataaaCCT | 543_1 | -20.62 | 115355 |
| 544 | GTACTTACACATCTAT | 2-10-4 | GTacttacacatCTAT | 544_1 | -18.96 | 116105 |
| 545 | TGTACTTACACATCTA | 3-10-3 | TGTacttacacatCTA | 545_1 | -19.38 | 116106 |
| 546 | ATTTCTCTATGTCACAT | 3-11-3 | ATTtctctatgtcaCAT | 546_1 | -19.28 | 117096 |
| 547 | CAAACCTACGTCTCTC | 2-10-4 | CAaacctacgtcTCTC | 547_1 | -20.87 | 117189 |
| 548 | GTATTTACTCTTTACCT | 3-11-3 | GTAtttactctttaCCT | 548_1 | -22.15 | 117476 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 549 | CTAATGCAATAACCCA | 2-10-4 | CTaatgcaataaCCCA | 549_1 | −21.79 | 118293 |
| 550 | ACTAATGCAATAACCC | 3-10-3 | ACTaatgcaataaCCC | 550_1 | −20.53 | 118294 |
| 551 | AGCTCTAAACCTTCAA | 3-10-3 | AGCtctaaaccttCAA | 551_1 | −20.51 | 118756 |
| 552 | TATTTGTCACCAAACC | 3-10-3 | TATttgtcaccaaACC | 552_1 | −19.63 | 119621 |
| 553 | CTCAGACATCTCAATA | 4-10-2 | CTCAgacatctcaaTA | 553_1 | −19.25 | 120655 |
| 554 | TCTCAGCTTCTTCAAAT | 2-12-3 | TCtcagcttcttcaAAT | 554_1 | −18.33 | 123733 |
| 555 | GCCAATACCCACAAAC | 3-10-3 | GCCaatacccacaAAC | 555_1 | −22.03 | 124163 |
| 556 | CCTCTGACAACCATTA | 4-10-2 | CCTCtgacaaccatTA | 556_1 | −22.57 | 125512 |
| 557 | CAGATAACTCTAAACC | 4-10-2 | CAGAtaactctaaaCC | 557_1 | −18.43 | 126882 |
| 558 | CTAACTGTTTCTCAATT | 3-11-3 | CTAactgtttctcaATT | 558_1 | −18.10 | 127105 |
| 559 | CCAAGATAATCATCAT | 3-10-3 | CCAagataatcatCAT | 559_1 | −18.37 | 127809 |
| 560 | TACATATTGTACTTCT | 4-10-2 | TACAtattgtacttCT | 560_1 | −17.48 | 129020 |
| 561 | TAGCCTACTTTAATAT | 4-10-2 | TAGCctactttaatAT | 561_1 | −18.67 | 129205 |
| 562 | CATTTACAAGCACATA | 2-10-4 | CAtttacaagcaCATA | 562_1 | −17.81 | 129928 |
| 563 | TTATTCTGACACACTT | 3-10-3 | TTAttctgacacaCTT | 563_1 | −17.49 | 130020 |
| 564 | TACATTGACACCTAAT | 4-10-2 | TACAttgacacctaAT | 564_1 | −17.37 | 130884 |
| 565 | TTTACATTGACACCTA | 2-10-4 | TTtacattgacaCCTA | 565_1 | −19.42 | 130886 |
| 566 | TGTATATAACTATTCC | 4-10-2 | TGTAtataactattCC | 566_1 | −17.79 | 131404 |
| 567 | GAATCTTCTAATTCCAC | 2-11-4 | GAatcttctaattCCAC | 567_1 | −20.40 | 132514 |
| 568 | TGCTCACTAACTACAC | 3-10-3 | TGCtcactaactaCAC | 568_1 | −20.66 | 133367 |
| 569 | TGCTACCATCATTACCT | 2-13-2 | TGctaccatcattacCT | 569_1 | −21.32 | 136198 |
| 570 | TTTATCAATATCTTCTCACT | 1-13-1-1-1-1-2 | TttatcaatatcttCtCaCT | 570_1 | −19.69 | 5784 |
| 570 | TTTATCAATATCTTCTCACT | 1-2-1-10-1-2-3 | TttAtcaatatcttCtcACT | 570_2 | −19.67 | 5784 |
| 570 | TTTATCAATATCTTCTCACT | 1-5-1-7-1-2-3 | TttatcAatatcttCtcACT | 570_3 | −19.65 | 5784 |
| 570 | TTTATCAATATCTTCTCACT | 1-1-1-11-1-3-2 | TtTatcaatatcttCtcaCT | 570_4 | −19.75 | 5784 |
| 570 | TTTATCAATATCTTCTCACT | 1-2-1-2-1-11-2 | TttAtcAatatcttctcaCT | 570_5 | −18.21 | 5784 |
| 570 | TTTATCAATATCTTCTCACT | 1-4-1-8-1-3-2 | TttatCaatatcttCtcaCT | 570_6 | −19.69 | 5784 |
| 570 | TTTATCAATATCTTCTCACT | 1-2-1-2-1-9-1-1-2 | TttAtcAatatcttctCaCT | 570_7 | −18.88 | 5784 |
| 570 | TTTATCAATATCTTCTCACT | 1-2-1-1-1-11-3 | TttAtCaatatcttctcACT | 570_8 | −19.36 | 5784 |
| 570 | TTTATCAATATCTTCTCACT | 1-4-1-10-1-1-2 | TttatCaatatcttctCaCT | 570_9 | −19.38 | 5784 |
| 570 | TTTATCAATATCTTCTCACT | 2-1-1-10-1-1-1-2 | TTTatcaatatcttCtCaCT | 570_10 | −20.60 | 5784 |
| 570 | TTTATCAATATCTTCTCACT | 1-4-1-8-1-1-1-2 | TttatCaatatcttCtCaCT | 570_11 | −20.36 | 5784 |
| 570 | TTTATCAATATCTTCTCACT | 1-2-1-1-1-8-1-2-3 | TttAtCaatatcttCtcACT | 570_12 | −20.34 | 5784 |
| 570 | TTTATCAATATCTTCTCACT | 1-2-1-2-1-7-1-3-2 | TttAtcAatatcttctcaCT | 570_13 | −19.19 | 5784 |
| 570 | TTTATCAATATCTTCTCACT | 1-1-2-1-1-10-1-1-2 | TtTAtCaatatcttctCaCT | 570_14 | −21.24 | 5784 |
| 571 | TTTATCAATATCTTCTCAC | 1-12-2-1-3 | TttatcaatatctTCtCAC | 571_1 | −19.16 | 5785 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 571 | TTTATCAATATCTTCTCAC | 2-1-1-1-1-6-2-2-3 | TTrAtCaatatcTTctCAC | 571_2 | -20.17 | 5785 |
| 571 | TTTATCAATATCTTCTCAC | 3-2-1-7-2-2-2 | TTTatCaatatctTCtcAC | 571_3 | -19.79 | 5785 |
| 571 | TTTATCAATATCTTCTCAC | 1-2-3-8-1-2-2 | TttATCaatatcttCtcAC | 571_4 | -18.78 | 5785 |
| 571 | TTTATCAATATCTTCTCAC | 1-4-1-9-4 | TttatCaatatcttcTCAC | 571_5 | -19.06 | 5785 |
| 571 | TTTATCAATATCTTCTCAC | 2-1-1-1-1-8-1-1-3 | TTrAtCaatatcttCtCAC | 571_6 | -19.75 | 5785 |
| 571 | TTTATCAATATCTTCTCAC | 1-1-1-2-1-6-1-3-3 | TtTatCaatatcTtctCAC | 571_7 | -19.11 | 5785 |
| 571 | TTTATCAATATCTTCTCAC | 2-1-3-6-1-4-2 | TTTATCaatatcTtctcAC | 571_8 | -19.13 | 5785 |
| 571 | TTTATCAATATCTTCTCAC | 4-12-3 | TTTAtcaatatcttctCAC | 571_9 | -20.38 | 5785 |
| 571 | TTTATCAATATCTTCTCAC | 1-1-2-1-1-6-1-3-3 | TtTatCaatatoTtctCAC | 571_10 | -20.24 | 5785 |
| 571 | TTTATCAATATCTTCTCAC | 2-1-1-1-1-7-2-2-2 | TTrAtCaatatctTCtcAC | 571_11 | -18.65 | 5785 |
| 571 | TTTATCAATATCTTCTCAC | 3-2-1-8-1-1-3 | TTTatCaatatottCtCAC | 571_12 | -20.89 | 5785 |
| 571 | TTTATCAATATCTTCTCAC | 1-3-2-8-1-1-3 | TttaTCaatatottCtCAC | 571_13 | -19.96 | 5785 |
| 571 | TTTATCAATATCTTCTCAC | 1-2-1-1-1-9-4 | TttAtCaatatottcTCAC | 571_14 | -19.16 | 5785 |
| 572 | TTTATCAATATCTTCTCA | 2-1-1-1-1-7-2-1-2 | TTrAtCaatatctTCtCA | 572_1 | -18.69 | 5786 |
| 572 | TTTATCAATATCTTCTCA | 3-2-1-6-1-1-1-1-2 | TTTatCaatatoTtCtCA | 572_2 | -19.36 | 5786 |
| 572 | TTTATCAATATCTTCTCA | 1-4-1-6-1-1-4 | TttatCaatatoTtCTCA | 572_3 | -19.19 | 5786 |
| 572 | TTTATCAATATCTTCTCA | 1-2-3-6-1-2-3 | TttATCaatatoTtcTCA | 572_4 | -19.56 | 5786 |
| 572 | TTTATCAATATCTTCTCA | 4-1-1-7-1-2-2 | TTTAtCaatatotTctCA | 572_5 | -19.37 | 5786 |
| 572 | TTTATCAATATCTTCTCA | 1-2-3-8-1-1-2 | TttATCaatatottCtCA | 572_6 | -18.83 | 5786 |
| 572 | TTTATCAATATCTTCTCA | 3-2-1-9-3 | TTTatCaatatottcTCA | 572_7 | -19.07 | 5786 |
| 572 | TTTATCAATATCTTCTCA | 1-2-1-10-4 | TttAtcaatatottCTCA | 572_8 | -18.10 | 5786 |
| 572 | TTTATCAATATCTTCTCA | 4-10-1-1-2 | TTTAtcaatatottCtCA | 572_9 | -19.31 | 5786 |
| 572 | TTTATCAATATCTTCTCA | 2-1-3-6-1-1-1-1-2 | TTTATCaatatoTtCtCA | 572_10 | -20.15 | 5786 |
| 572 | TTTATCAATATCTTCTCA | 3-2-1-6-1-2-3 | TTTatCaatatoTtcTCA | 572_11 | -19.59 | 5786 |
| 572 | TTTATCAATATCTTCTCA | 1-1-2-1-1-7-2-1-2 | TtTAtCaatatotTCtCA | 572_12 | -19.64 | 5786 |
| 572 | TTTATCAATATCTTCTCA | 4-9-1-1-3 | TTTAtcaatatotTcTCA | 572_13 | -19.90 | 5786 |
| 572 | TTTATCAATATCTTCTCA | 1-3-2-8-4 | TttaTCaatatcttCTCA | 572_14 | -19.80 | 5786 |
| 573 | TATACCTTTCTTTAACCCTT | 1-4-1-10-1-1-2 | TatacCtttctttaacCcTT | 573_1 | -22.72 | 8116 |
| 573 | TATACCTTTCTTTAACCCTT | 2-4-1-11-2 | TAtaccTttctttaacccTT | 573_2 | -22.80 | 8116 |
| 573 | TATACCTTTCTTTAACCCTT | 1-3-1-10-1-2-2 | TataCctttctttaacCcTT | 573_3 | -22.72 | 8116 |
| 573 | TATACCTTTCTTTAACCCTT | 1-4-1-9-1-2-2 | TatacCtttctttaaCccTT | 573_4 | -22.82 | 8116 |
| 573 | TATACCTTTCTTTAACCCTT | 1-5-1-9-1-1-2 | TataccTttctttaacCcTT | 573_5 | -22.35 | 8116 |
| 573 | TATACCTTTCTTTAACCCTT | 1-5-1-1-1-2 | TataccttttctttaacCcTT | 573_6 | -21.83 | 8116 |
| 573 | TATACCTTTCTTTAACCCTT | 1-2-1-1-1-10-1-1-2 | TatAcTttctttaacCcTT | 573_7 | -22.91 | 8116 |
| 573 | TATACCTTTCTTTAACCCTT | 2-2-1-1-1-11-2 | TAtaCcTttctttaacccTT | 573_8 | -23.58 | 8116 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 573 | TATACCTTTCTTTAACCCTT | 2-3-1-12-2 | TAtacCtttctttaacccTT | 573_9 | −23.17 | 8116 |
| 573 | TATACCTTTCTTTAACCCTT | 1-3-1-8-2-1-1-1-2 | TataCctttctttAAcCcTT | 573_10 | −23.35 | 8116 |
| 573 | TATACCTTTCTTTAACCCTT | 2-2-1-1-1-7-1-1-1-1-2 | TAtaCcTttctttaAcCcTT | 573_11 | −24.68 | 8116 |
| 573 | TATACCTTTCTTTAACCCTT | 2-4-1-8-2-1-2 | TAtaccTttctttaaCCcTT | 573_12 | −25.86 | 8116 |
| 573 | TATACCTTTCTTTAACCCTT | 2-3-1-9-1-2-2 | TAtacCtttctttaaCccTT | 573_13 | −23.96 | 8116 |
| 573 | TATACCTTTCTTTAACCCTT | 2-3-1-10-1-1-2 | TAtacCtttctttaacCcTT | 573_14 | −23.85 | 8116 |
| 574 | TTATACCTTTCTTTAACCCT | 1-1-1-10-1-4-2 | TtAtaccttttcttTaaccCT | 574_1 | −22.31 | 8117 |
| 574 | TTATACCTTTCTTTAACCCT | 1-13-1-1-1-1-2 | TtataccttttctttAaCcCT | 574_2 | −22.38 | 8117 |
| 574 | TTATACCTTTCTTTAACCCT | 1-1-1-3-1-11-2 | TtAtaCtttctttaaccCT | 574_3 | −22.47 | 8117 |
| 574 | TTATACCTTTCTTTAACCCT | 1-3-1-1-1-7-1-3-2 | TtatAcTtttctttAaccCT | 574_4 | −22.68 | 8117 |
| 574 | TTATACCTTTCTTTAACCCT | 1-4-1-8-1-3-2 | TtataCctttctttAaccCT | 574_5 | −22.38 | 8117 |
| 574 | TTATACCTTTCTTTAACCCT | 1-1-1-13-1-1-2 | TtAtaCtttctttaaCcCT | 574_6 | −22.36 | 8117 |
| 574 | TTATACCTTTCTTTAACCCT | 1-3-1-11-1-1-2 | TtatAccttttctttaaCcCT | 574_7 | −22.46 | 8117 |
| 574 | TTATACCTTTCTTTAACCCT | 1-1-1-2-1-12-2 | TtAtaCctttctttaaccCT | 574_8 | −22.36 | 8117 |
| 574 | TTATACCTTTCTTTAACCCT | 1-5-1-11-2 | TtatacCtttctttaaccCT | 574_9 | −22.37 | 8117 |
| 574 | TTATACCTTTCTTTAACCCT | 1-1-1-2-1-10-1-1-2 | TtAtaCctttctttaaCcCT | 574_10 | −23.14 | 8117 |
| 574 | TTATACCTTTCTTTAACCCT | 1-1-1-3-1-9-1-1-2 | TtAtaCtttctttaaCcCT | 574_11 | −23.25 | 8117 |
| 574 | TTATACCTTTCTTTAACCCT | 1-1-1-3-1-10-3 | TtAtaCtttctttaacCCT | 574_12 | −24.75 | 8117 |
| 574 | TTATACCTTTCTTTAACCCT | 1-1-1-2-2-11-2 | TtAtaCCtttctttaaccCT | 574_13 | −24.85 | 8117 |
| 574 | TTATACCTTTCTTTAACCCT | 1-3-1-1-1-11-2 | TtatAcCtttctttaaccCT | 574_14 | −22.56 | 8117 |
| 575 | TTTATACCTTTCTTTAACCC | 1-2-1-9-1-4-2 | TttAtacctttctTtaacCC | 575_1 | −21.69 | 8118 |
| 575 | TTTATACCTTTCTTTAACCC | 1-12-1-4-2 | TttatacctttctTtaacCC | 575_2 | −21.59 | 8118 |
| 575 | TTTATACCTTTCTTTAACCC | 1-12-1-1-1-2-2 | TttatacctttctTtAacCC | 575_3 | −21.71 | 8118 |
| 575 | TTTATACCTTTCTTTAACCC | 1-4-1-10-1-1-2 | TttatAcctttctttaAcCC | 575_4 | −21.90 | 8118 |
| 575 | TTTATACCTTTCTTTAACCC | 1-13-1-3-2 | Tttatacctttctttaaccc | 575_5 | −22.01 | 8118 |
| 575 | TTTATACCTTTCTTTAACCC | 2-1-1-14-2 | TTTatacctttctttaacCC | 575_6 | −22.20 | 8118 |
| 575 | TTTATACCTTTCTTTAACCC | 1-14-2-1-2 | TttatacctttctttAAcCC | 575_7 | −22.02 | 8118 |
| 575 | TTTATACCTTTCTTTAACCC | 1-14-1-2-2 | TttatacctttctttAacCC | 575_8 | −21.41 | 8118 |
| 575 | TTTATACCTTTCTTTAACCC | 1-15-1-1-2 | TttatacctttcttttaAcCC | 575_9 | −21.71 | 8118 |
| 575 | TTTATACCTTTCTTTAACCC | 2-1-1-9-1-4-2 | TTTatacctttctTtaacCC | 575_10 | −22.50 | 8118 |
| 575 | TTTATACCTTTCTTTAACCC | 1-2-1-10-1-3-2 | TttAtacctttcttTaacCC | 575_11 | −22.11 | 8118 |
| 575 | TTTATACCTTTCTTTAACCC | 1-4-2-8-2-1-2 | TttatACctttctttAAcCC | 575_12 | −23.40 | 8118 |
| 575 | TTTATACCTTTCTTTAACCC | 1-2-1-2-1-9-1-1-2 | TttAtaCctttctttaAcCC | 575_13 | −22.59 | 8118 |
| 575 | TTTATACCTTTCTTTAACCC | 1-1-2-14-2 | TtTAtacctttctttaacCC | 575_14 | −23.15 | 8118 |
| 576 | TTTTATACCTTTCTTTAACC | 1-1-1-10-2-3-2 | TtTtataccttttcTTtaaCC | 576_1 | −21.12 | 8119 |
| 576 | TTTTATACCTTTCTTTAACC | 1-3-1-8-1-4-2 | TtttAtacctttcTttaaCC | 576_2 | −20.10 | 8119 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 576 | TTTTATACCTTTCTTTAACC | 1-1-1-10-1-2-4 | TtTtataccttttcTttAACC | 576_3 | -21.45 | 8119 |
| 576 | TTTTATACCTTTCTTTAACC | 3-11-1-1-1-1-2 | TTTtataccttttctTtAaCC | 576_4 | -21.54 | 8119 |
| 576 | TTTTATACCTTTCTTTAACC | 2-4-1-7-1-3-2 | TTttatAccttttctTtaaCC | 576_5 | -20.80 | 8119 |
| 576 | TTTTATACCTTTCTTTAACC | 1-14-1-2-2 | TtttataccttttctttTaaCC | 576_6 | -20.22 | 8119 |
| 576 | TTTTATACCTTTCTTTAACC | 1-15-1-1-2 | TtttataccttttctttAaCC | 576_7 | -19.61 | 8119 |
| 576 | TTTTATACCTTTCTTTAACC | 1-5-1-10-3 | TtttatAccttttctttaACC | 576_8 | -20.51 | 8119 |
| 576 | TTTTATACCTTTCTTTAACC | 1-1-2-14-2 | TtTtatacctttttctttaaCC | 576_9 | -21.03 | 8119 |
| 576 | TTTTATACCTTTCTTTAACC | 1-1-2-10-1-1-1-2 | TtTTatacctttttctTtAaCC | 576_10 | -21.46 | 8119 |
| 576 | TTTTATACCTTTCTTTAACC | 2-2-1-9-1-3-2 | TTttAtacctttttctTtaaCC | 576_11 | -20.70 | 8119 |
| 576 | TTTTATACCTTTCTTTAACC | 1-5-1-7-1-3-2 | TttttAtAccttttctTtaaCC | 576_12 | -19.99 | 8119 |
| 576 | TTTTATACCTTTCTTTAACC | 1-1-1-12-2-1-2 | TtTtatacctttttcttTAaCC | 576_13 | -21.68 | 8119 |
| 576 | TTTTATACCTTTCTTTAACC | 1-1-1-1-1-13-2 | TtTtAtacctttttctttaaCC | 576_14 | -19.89 | 8119 |
| 577 | TTTTTATACCTTTCTTTAAC | 1-12-1-2-4 | TttttataccttttCttTAAC | 577_1 | -19.19 | 8120 |
| 577 | TTTTTATACCTTTCTTTAAC | 1-2-1-9-1-1-2-1-2 | TttTtataccttttCtTTaAC | 577_2 | -18.96 | 8120 |
| 577 | TTTTTATACCTTTCTTTAAC | 2-12-3-1-2 | TTttttataccttttcTTTaAC | 577_3 | -19.52 | 8120 |
| 577 | TTTTTATACCTTTCTTTAAC | 1-1-1-2-1-7-2-3-2 | TtTttAtaccttttCTttaAC | 577_4 | -18.71 | 8120 |
| 577 | TTTTTATACCTTTCTTTAAC | 4-9-1-1-1-2-2 | TTTTtataccttttCtTtaAC | 577_5 | -19.85 | 8120 |
| 577 | TTTTTATACCTTTCTTTAAC | 3-1-1-8-1-1-1-3 | TTTtTataccttttCtTtAAC | 577_6 | -20.08 | 8120 |
| 577 | TTTTTATACCTTTCTTTAAC | 2-1-2-8-2-2-3 | TTtTTataccttttCTttAAC | 577_7 | -20.97 | 8120 |
| 577 | TTTTTATACCTTTCTTTAAC | 1-1-2-10-2-1-3 | TtTTtataccttttcTTTAAC | 577_8 | -18.89 | 8120 |
| 577 | TTTTTATACCTTTCTTTAAC | 1-3-2-7-1-4-2 | TttttTatAccttttCttttaAC | 577_9 | -18.97 | 8120 |
| 577 | TTTTTATACCTTTCTTTAAC | 1-2-1-9-2-1-1-2 | TttTtataccttttCTtTaAC | 577_10 | -19.34 | 8120 |
| 577 | TTTTTATACCTTTCTTTAAC | 2-3-1-7-2-2-3 | TTtttAtaccttttCTttAAC | 577_11 | -19.53 | 8120 |
| 577 | TTTTTATACCTTTCTTTAAC | 1-1-2-9-1-1-1-3 | TtTTtataccttttCtTtAAC | 577_12 | -18.84 | 8120 |
| 577 | TTTTTATACCTTTCTTTAAC | 1-3-2-7-1-1-1-2-2 | TttttTAtaccttttCtTtaAC | 577_13 | -19.27 | 8120 |
| 577 | TTTTTATACCTTTCTTTAAC | 3-1-1-8-1-2-1-1-2 | TTTtTataccttttCttTaAC | 577_14 | -20.20 | 8120 |
| 578 | TTTTTTCTTACTATCTTCAA | 1-5-1-7-2-2-2 | TttttttCttactatCTtcAA | 578_1 | -19.02 | 8584 |
| 578 | TTTTTTCTTACTATCTTCAA | 2-2-1-1-1-7-1-1-1-2 | TTtttTCttactatCtTcAA | 578_2 | -19.31 | 8584 |
| 578 | TTTTTTCTTACTATCTTCAA | 1-2-2-9-1-2-3 | TttTTtcttactatCttCAA | 578_3 | -20.05 | 8584 |
| 578 | TTTTTTCTTACTATCTTCAA | 1-1-1-1-1-1-7-1-3-2 | TtTtTtCttactatCttcAA | 578_4 | -18.43 | 8584 |
| 578 | TTTTTTCTTACTATCTTCAA | 3-3-1-8-1-2-2 | TTTtttCttactatcTtcAA | 578_5 | -18.99 | 8584 |
| 578 | TTTTTTCTTACTATCTTCAA | 2-1-2-1-1-8-1-2-2 | TTtTTtCttactatcttcAA | 578_6 | -19.29 | 8584 |
| 578 | TTTTTTCTTACTATCTTCAA | 1-1-3-1-1-9-1-1-2 | TtTTTtCttactatctTcAA | 578_7 | -19.15 | 8584 |
| 578 | TTTTTTCTTACTATCTTCAA | 2-1-1-11-1-1-3 | TTtTttcttactatcTtCAA | 578_8 | -19.58 | 8584 |
| 578 | TTTTTTCTTACTATCTTCAA | 1-4-1-10-4 | TttttTcttactatctTCAA | 578_9 | -19.31 | 8584 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 579 | TTTTTTTCTTACTATCTTCA | 1-12-1-1-1-2-2 | TtttttttcttactAtCttCA | 579_1 | -19.29 | 8585 |
| 579 | TTTTTTTCTTACTATCTTCA | 2-1-1-9-1-4-2 | TTtTtttcttactAtcttCA | 579_2 | -19.42 | 8585 |
| 579 | TTTTTTTCTTACTATCTTCA | 1-1-1-2-1-7-1-4-2 | TtTttTtcttactAtcttCA | 579_3 | -18.91 | 8585 |
| 579 | TTTTTTTCTTACTATCTTCA | 1-1-2-9-1-2-1-1-2 | TtTTtttcttactAtcTtCA | 579_4 | -19.94 | 8585 |
| 579 | TTTTTTTCTTACTATCTTCA | 1-3-2-10-1-1-2 | TttttTtcttactatcTtCA | 579_5 | -19.84 | 8585 |
| 579 | TTTTTTTCTTACTATCTTCA | 2-3-1-12-2 | TTtttTtcttactatcttCA | 579_6 | -19.33 | 8585 |
| 579 | TTTTTTTCTTACTATCTTCA | 3-15-2 | TTTttttcttactatcttCA | 579_7 | -19.84 | 8585 |
| 579 | TTTTTTTCTTACTATCTTCA | 1-2-2-13-2 | TttTTttcttactatcttCA | 579_8 | -19.33 | 8585 |
| 579 | TTTTTTTCTTACTATCTTCA | 1-14-1-2-2 | TttttttcttactatCttCA | 579_9 | -19.19 | 8585 |
| 580 | ATTTTTTTCTTACTATCTTC | 1-4-1-8-1-1-1-2 | AttttTttcttactAtCtTC | 580_1 | -18.09 | 8586 |
| 580 | ATTTTTTTCTTACTATCTTC | 2-1-1-10-1-2-3 | ATtTttttcttactAtcTTC | 580_2 | -19.39 | 8586 |
| 580 | ATTTTTTTCTTACTATCTTC | 1-3-2-8-1-2-3 | AtttTTttcttactAtcTTC | 580_3 | -18.95 | 8586 |
| 580 | ATTTTTTTCTTACTATCTTC | 1-5-1-6-1-3-3 | AttttttTcttacTatcTTC | 580_4 | -18.98 | 8586 |
| 580 | ATTTTTTTCTTACTATCTTC | 2-2-1-1-1-7-1-3-2 | ATttTtTtcttactAtctTC | 580_5 | -18.66 | 8586 |
| 580 | ATTTTTTTCTTACTATCTTC | 1-1-3-8-1-4-2 | AtTTTtttcttacTatctTC | 580_6 | -19.58 | 8586 |
| 580 | ATTTTTTTCTTACTATCTTC | 2-1-1-12-1-1-2 | ATtTttttcttactatCtTC | 580_7 | -19.24 | 8586 |
| 580 | ATTTTTTTCTTACTATCTTC | 1-1-1-2-1-11-3 | AtTttTttcttactatcTTC | 580_8 | -18.34 | 8586 |
| 580 | ATTTTTTTCTTACTATCTTC | 1-1-2-1-2-11-2 | AtTTtTTtcttactatctTC | 580_9 | -18.94 | 8586 |
| 581 | AATTTTTTTCTTACTATCTT | 1-4-1-7-1-1-1-3 | AatttTtttcttaCtAtCTT | 581_1 | -18.53 | 8587 |
| 581 | AATTTTTTTCTTACTATCTT | 1-3-1-1-1-6-2-3-2 | AattTtTttcttaCTatcTT | 581_2 | -18.69 | 8587 |
| 581 | AATTTTTTTCTTACTATCTT | 1-1-2-10-2-2-2 | AaTTtttttcttacTAtcTT | 581_3 | -18.80 | 8587 |
| 581 | AATTTTTTTCTTACTATCTT | 2-1-1-1-1-8-1-2-3 | AAtTtTttttcttacTatCTT | 581_4 | -19.20 | 8587 |
| 581 | AATTTTTTTCTTACTATCTT | 4-2-1-7-1-3-2 | AATTttttttcttacTatcTT | 581_5 | -19.30 | 8587 |
| 581 | AATTTTTTTCTTACTATCTT | 2-2-2-7-1-1-2-1-2 | AAtttTttttcttaCtATcTT | 581_6 | -19.52 | 8587 |
| 581 | AATTTTTTTCTTACTATCTT | 1-12-1-2-4 | AattttttttcttaCtaTCTT | 581_7 | -19.25 | 8587 |
| 581 | AATTTTTTTCTTACTATCTT | 1-1-4-7-1-4-2 | AaTTTTttcttaCtatcTT | 581_8 | -19.35 | 8587 |
| 581 | AATTTTTTTCTTACTATCTT | 2-1-3-9-1-1-3 | AAtTTTtttcttactAtCTT | 581_9 | -19.68 | 8587 |
| 582 | GTTTATACCCTTTCCAAT | 1-1-1-1-7-2-2-2 | GtTtAtacccttTCcaAT | 582_1 | -21.48 | 9209 |
| 582 | GTTTATACCCTTTCCAAT | 1-12-2-1-2 | GtttatacccttCCaAT | 582_2 | -22.28 | 9209 |
| 582 | GTTTATACCCTTTCCAAT | 1-3-1-8-1-1-3 | GtttAtaccctttCcAAT | 582_3 | -20.46 | 9209 |
| 582 | GTTTATACCCTTTCCAAT | 1-1-1-1-1-9-1-1-2 | GtTtAtaccctttcCaAT | 582_4 | -20.30 | 9209 |
| 582 | GTTTATACCCTTTCCAAT | 2-11-1-2-2 | GTttataccctttCcaAT | 582_5 | -21.64 | 9209 |
| 582 | GTTTATACCCTTTCCAAT | 1-1-2-9-1-1-3 | GtTTataccctttCcAAT | 582_6 | -21.90 | 9209 |
| 582 | GTTTATACCCTTTCCAAT | 1-1-1-13-2 | GtTtataccctttccaAT | 582_7 | -19.63 | 9209 |
| 582 | GTTTATACCCTTTCCAAT | 1-2-1-12-2 | GttTataccctttccaAT | 582_8 | -20.05 | 9209 |
| 582 | GTTTATACCCTTTCCAAT | 1-13-4 | GtttataccctttcCAAT | 582_9 | -21.59 | 9209 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 583 | TGTTTATACCCTTTCCAA | 2-1-1-10-1-1-2 | TGtTtatacccttCcAA | 583_1 | −21.08 | 9210 |
| 583 | TGTTTATACCCTTTCCAA | 1-4-1-6-1-1-1-2 | TgtttAtaccctTtCcAA | 583_2 | −19.97 | 9210 |
| 583 | TGTTTATACCCTTTCCAA | 1-3-1-9-1-1-2 | TgttTatacccttCcAA | 583_3 | −20.30 | 9210 |
| 583 | TGTTTATACCCTTTCCAA | 2-1-1-1-1-6-1-3-2 | TGtTAtaccctTtccAA | 583_4 | −20.71 | 9210 |
| 583 | TGTTTATACCCTTTCCAA | 1-2-1-8-1-2-3 | TgtTtataccctTtcCAA | 583_5 | −21.40 | 9210 |
| 583 | TGTTTATACCCTTTCCAA | 1-4-1-9-3 | TgtttAtacccttcCAA | 583_6 | −20.89 | 9210 |
| 583 | TGTTTATACCCTTTCCAA | 1-1-2-12-2 | TgTTtacccttccAA | 583_7 | −20.27 | 9210 |
| 583 | TGTTTATACCCTTTCCAA | 1-12-2-1-2 | TgtttataccctTCcAA | 583_8 | −20.56 | 9210 |
| 583 | TGTTTATACCCTTTCCAA | 2-2-1-11-2 | TGttTatacccttccAA | 583_9 | −20.74 | 9210 |
| 584 | CTGTTTATACCCTTTCCA | 1-1-1-10-1-2-2 | CtGtttataccctTtcCA | 584_1 | −22.45 | 9211 |
| 584 | CTGTTTATACCCTTTCCA | 1-12-1-2-2 | CtgtttataccctTtcCA | 584_2 | −22.14 | 9211 |
| 584 | CTGTTTATACCCTTTCCA | 1-1-1-1-1-11-2 | CtGtTtataccctttcCA | 584_3 | −22.45 | 9211 |
| 584 | CTGTTTATACCCTTTCCA | 1-1-1-13-2 | CtGtttataccctttcCA | 584_4 | −22.15 | 9211 |
| 584 | CTGTTTATACCCTTTCCA | 1-2-1-12-2 | CtgTttataccctttcCA | 584_5 | −22.50 | 9211 |
| 584 | CTGTTTATACCCTTTCCA | 1-3-1-11-2 | CtgtTtataccctttcCA | 584_6 | −22.14 | 9211 |
| 584 | CTGTTTATACCCTTTCCA | 1-4-1-10-2 | CtgttTataccctttcCA | 584_7 | −22.57 | 9211 |
| 584 | CTGTTTATACCCTTTCCA | 1-15-2 | CtgtttataccctttcCA | 584_8 | −21.84 | 9211 |
| 585 | AATTATTTATACACCATCAT | 2-1-1-1-1-8-3-1-2 | AAtTaTttatacacCATcAT | 585_1 | −20.76 | 11511 |
| 585 | AATTATTTATACACCATCAT | 3-2-2-6-1-1-2-1-2 | AATtaTTtatacaCcATcAT | 585_2 | −20.88 | 11511 |
| 585 | AATTATTTATACACCATCAT | 1-4-1-7-2-1-1-2 | AattaTttatacaCCaTcAT | 585_3 | −19.62 | 11511 |
| 585 | AATTATTTATACACCATCAT | 1-3-1-1-1-6-1-3-3 | AattAtTtatacaCcatCAT | 585_4 | −18.98 | 11511 |
| 585 | AATTATTTATACACCATCAT | 1-2-3-7-1-1-1-2-2 | AatTATttatacaCcAtcAT | 585_5 | −19.65 | 11511 |
| 585 | AATTATTTATACACCATCAT | 1-1-2-11-1-1-3 | AaTTatttatacaccAtCAT | 585_6 | −19.53 | 11511 |
| 585 | AATTATTTATACACCATCAT | 2-2-1-9-1-1-4 | AAttAtttatacacCaTCAT | 585_7 | −20.11 | 11511 |
| 585 | AATTATTTATACACCATCAT | 3-1-2-8-1-2-3 | AATTAtttatacacCatCAT | 585_8 | −21.48 | 11511 |
| 585 | AATTATTTATACACCATCAT | 4-2-1-7-1-3-2 | AATTatTtatacacCatcAT | 585_9 | −19.60 | 11511 |
| 585 | AATTATTTATACACCATCAT | 2-1-1-2-1-6-3-2-2 | AAtTatTtatacaCCAtcAT | 585_10 | −21.69 | 11511 |
| 585 | AATTATTTATACACCATCAT | 1-3-2-7-1-1-1-1-3 | AattATttatacaCcAtCAT | 585_11 | −19.97 | 11511 |
| 585 | AATTATTTATACACCATCAT | 2-1-3-8-1-1-1-2 | AAtTATtatacacCaTcAT | 585_12 | −20.42 | 11511 |
| 585 | AATTATTTATACACCATCAT | 1-1-2-1-1-8-1-2-3 | AaTTaTttatacacCatCAT | 585_13 | −20.49 | 11511 |
| 585 | AATTATTTATACACCATCAT | 2-1-1-2-1-9-4 | AAtTatTtataccaTCAT | 585_14 | −20.47 | 11511 |
| 586 | AAATTATTTATACACCATCA | 1-12-3-1-3 | AaattatttatacACCaTCA | 586_1 | −20.58 | 11512 |
| 586 | AAATTATTTATACACCATCA | 1-1-1-2-1-7-1-1-2-1-2 | AaAttAtttatacAcCAtCA | 586_2 | −18.56 | 11512 |
| 586 | AAATTATTTATACACCATCA | 3-2-2-6-2-3-2 | AAAttATttatacACCcatCA | 586_3 | −19.68 | 11512 |
| 586 | AAATTATTTATACACCATCA | 4-10-1-2-3 | AAATtatttatacaCcaTCA | 586_4 | −20.15 | 11512 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 586 | AAATTATTTATACACCATCA | 1-1-4-8-1-1-1-1-2 | AaATTAtttatacaCcAtCA | 586_5 | −20.72 | 11512 |
| 586 | AAATTATTTATACACCATCA | 2-1-2-1-1-7-1-3-2 | AAaTTaTtttatacaCcatCA | 586_6 | −19.39 | 11512 |
| 586 | AAATTATTTATACACCATCA | 1-3-2-7-1-1-1-1-3 | AaatTAtttatacAcCaTCA | 586_7 | −19.65 | 11512 |
| 586 | AAATTATTTATACACCATCA | 1-1-3-8-1-2-4 | AaATTatttatacAccATCA | 586_8 | −20.88 | 11512 |
| 586 | AAATTATTTATACACCATCA | 2-2-1-1-9-4 | AAatTaTttatacaccATCA | 586_9 | −19.63 | 11512 |
| 586 | AAATTATTTATACACCATCA | 1-1-1-1-1-1-1-6-3-2-2 | AaAtTaTttatacACCatCA | 586_10 | −20.95 | 11512 |
| 586 | AAATTATTTATACACCATCA | 1-3-2-7-1-1-2-1-2 | AaatTAtttatacAcCAtCA | 586_11 | −20.00 | 11512 |
| 586 | AAATTATTTATACACCATCA | 2-1-2-1-1-7-1-1-1-2 | AAaTTaTtttatacCcAtCA | 586_12 | −19.44 | 11512 |
| 586 | AAATTATTTATACACCATCA | 3-2-1-8-1-2-3 | AAAttAtttatacCcaTCA | 586_13 | −19.00 | 11512 |
| 586 | AAATTATTTATACACCATCA | 1-1-4-9-1-1-3 | AaATTAtttatacacCaTCA | 586_14 | −21.59 | 11512 |
| 587 | AAAATTATTTATACACCATC | 2-3-1-7-1-1-5 | AAaatTatttataCaCCATC | 587_1 | −21.17 | 11513 |
| 587 | AAAATTATTTATACACCATC | 1-2-2-9-6 | AaaATtatttatacACCATC | 587_2 | −21.34 | 11513 |
| 587 | AAAATTATTTATACACCATC | 2-3-2-6-3-1-3 | AAaatTAtttataCACcATC | 587_3 | −20.67 | 11513 |
| 587 | AAAATTATTTATACACCATC | 3-1-1-1-1-7-3-1-2 | AAAaTtAtttatacACCaTC | 587_4 | −19.11 | 11513 |
| 587 | AAAATTATTTATACACCATC | 7-6-1-1-1-2-2 | AAAATTAtttataCaCcaTC | 587_5 | −20.66 | 11513 |
| 587 | AAAATTATTTATACACCATC | 1-1-1-1-2-8-2-1-3 | AaAaTTatttatacACcATC | 587_6 | −18.20 | 11513 |
| 587 | AAAATTATTTATACACCATC | 1-1-5-6-2-3-2 | AaAATTAtttatacAccaTC | 587_7 | −20.71 | 11513 |
| 587 | AAAATTATTTATACACCATC | 2-1-3-7-1-2-4 | AAaATTAtttataCacCATC | 587_8 | −20.87 | 11513 |
| 587 | AAAATTATTTATACACCATC | 4-1-1-8-1-1-4 | AAAAtTatttatacAcCATC | 587_9 | −19.30 | 11513 |
| 587 | AAAATTATTTATACACCATC | 1-1-2-1-2-6-3-2-2 | AaAAtTAtttataCACCaTC | 587_10 | −20.13 | 11513 |
| 587 | AAAATTATTTATACACCATC | 1-2-3-7-1-1-2-1-2 | AaaATTatttataCaCCaTC | 587_11 | −20.44 | 11513 |
| 587 | AAAATTATTTATACACCATC | 3-1-2-7-1-2-4 | AAAaTTatttataCacCATC | 587_12 | −20.27 | 11513 |
| 587 | AAAATTATTTATACACCATC | 3-2-1-8-3-1-2 | AAAatTatttatacACCaTC | 587_13 | −19.30 | 11513 |
| 587 | AAAATTATTTATACACCATC | 2-1-3-8-2-1-3 | AAaATTAtttatacACcATC | 587_14 | −19.52 | 11513 |
| 588 | TAAAATTATTTATACACCAT | 2-3-1-7-1-1-5 | TAaaaTtatttatAcACCAT | 588_1 | −20.14 | 11514 |
| 588 | TAAAATTATTTATACACCAT | 1-2-1-2-1-6-2-1-4 | TaaAatTatttatACaCCAT | 588_2 | −20.15 | 11514 |
| 588 | TAAAATTATTTATACACCAT | 1-1-1-2-8-1-1-4 | TaAaATtatttataCaCCAT | 588_3 | −20.40 | 11514 |
| 588 | TAAAATTATTTATACACCAT | 4-1-2-6-4-1-2 | TAAAaTTatttatACAcCAT | 588_4 | −21.36 | 11514 |
| 588 | TAAAATTATTTATACACCAT | 1-3-3-6-3-1-3 | TaaaATTatttatACAcCAT | 588_5 | −21.07 | 11514 |
| 588 | TAAAATTATTTATACACCAT | 2-1-4-7-3-1-2 | TAaAATTAtttataCACcAT | 588_6 | −21.36 | 11514 |
| 588 | TAAAATTATTTATACACCAT | 3-1-1-1-7-2-1-3 | TAAAatTatttataCAcCAT | 588_7 | −20.41 | 11514 |
| 588 | TAAAATTATTTATACACCAT | 7-6-1-3-3 | TAAAATTatttatAcacCAT | 588_8 | −20.85 | 11514 |
| 588 | TAAAATTATTTATACACCAT | 2-1-2-11-4 | TAaAttatttatacaCCAT | 588_9 | −19.82 | 11514 |
| 588 | TAAAATTATTTATACACCAT | 2-2-3-6-4-1-2 | TAaATTatttatACAcCAT | 588_10 | −21.41 | 11514 |
| 588 | TAAAATTATTTATACACCAT | 1-1-1-1-3-6-1-2-4 | TaAaATTatttatAcaCCAT | 588_11 | −21.15 | 11514 |
| 588 | TAAAATTATTTATACACCAT | 2-1-2-1-1-7-2-1-3 | TAaAtTatttataCAcCAT | 588_12 | −20.41 | 11514 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 588 | TAAAATTATTTATACACCAT | 3-2-2-7-1-1-4 | TAAaaTTatttataCaCCAT | 588_13 | -21.86 | 11514 |
| 588 | TAAAATTATTTATACACCAT | 1-1-2-1-1-9-5 | TaAAaTtatttatacACCAT | 588_14 | -19.68 | 11514 |
| 589 | TAAAATTATTTATACACCA | 1-1-2-1-1-7-6 | TaAAaTtatttatACACCA | 589_1 | -20.31 | 11515 |
| 589 | TAAAATTATTTATACACCA | 1-2-3-6-1-1-5 | TaaAATtatttaTaCACCA | 589_2 | -21.36 | 11515 |
| 589 | TAAAATTATTTATACACCA | 2-3-1-7-6 | TAaaaTtatttatACACCA | 589_3 | -20.58 | 11515 |
| 589 | TAAAATTATTTATACACCA | 3-1-2-6-4-1-2 | TAAaATtatttaTACAcCA | 589_4 | -21.36 | 11515 |
| 589 | TAAAATTATTTATACACCA | 4-1-1-6-2-2-3 | TAAAaTtatttaTAcaCCA | 589_5 | -20.51 | 11515 |
| 589 | TAAAATTATTTATACACCA | 2-1-2-7-1-1-1-3 | TAaAAttatttaTaCaCCA | 589_6 | -19.30 | 11515 |
| 589 | TAAAATTATTTATACACCA | 1-3-2-6-2-2-3 | TaaaAAtatttaTAcaCCA | 589_7 | -19.40 | 11515 |
| 589 | TAAAATTATTTATACACCA | 5-8-2-1-3 | TAAAAttatttatACaCCA | 589_8 | -19.77 | 11515 |
| 589 | TAAAATTATTTATACACCA | 3-1-2-9-4 | TAAaATtatttatacACCA | 589_9 | -19.55 | 11515 |
| 589 | TAAAATTATTTATACACCA | 2-1-3-6-4-1-2 | TAaAATtatttaTACAcCA | 589_10 | -21.36 | 11515 |
| 589 | TAAAATTATTTATACACCA | 3-1-2-6-3-1-3 | TAAaATtatttaTACaCCA | 589_11 | -22.18 | 11515 |
| 589 | TAAAATTATTTATACACCA | 1-1-3-7-2-1-4 | TaAAAtatttaTAcACCA | 589_12 | -19.78 | 11515 |
| 589 | TAAAATTATTTATACACCA | 2-2-1-7-1-1-1-3 | TAaAAttatttaTaCaCCA | 589_13 | -18.76 | 11515 |
| 589 | TAAAATTATTTATACACCA | 4-1-1-8-5 | TAAAaTtatttataCACCA | 589_14 | -21.06 | 11515 |
| 590 | ATATTGATTCAATTCCC | 2-9-2-1-3 | ATattgattcaATtCCC | 590_1 | -21.84 | 13226 |
| 590 | ATATTGATTCAATTCCC | 1-2-1-7-6 | AtaTtgattcaATTCCC | 590_2 | -22.10 | 13226 |
| 590 | ATATTGATTCAATTCCC | 2-9-1-1-1-2 | ATattgattcaAtTcCC | 590_3 | -18.59 | 13226 |
| 590 | ATATTGATTCAATTCCC | 1-1-2-8-5 | AtATtgattcaaTTCCC | 590_4 | -21.87 | 13226 |
| 590 | ATATTGATTCAATTCCC | 1-2-2-7-2-1-2 | AtaTTgattcaaTTcCC | 590_5 | -19.29 | 13226 |
| 590 | ATATTGATTCAATTCCC | 1-3-1-6-2-2-2 | AtatTgattcaATtcCC | 590_6 | -18.59 | 13226 |
| 590 | ATATTGATTCAATTCCC | 1-2-2-6-1-2-3 | AtaTTgattcaAttCCC | 590_7 | -20.66 | 13226 |
| 590 | ATATTGATTCAATTCCC | 1-1-1-1-1-7-1-1-3 | AtAtTgattcaaTtCCC | 590_8 | -19.92 | 13226 |
| 590 | ATATTGATTCAATTCCC | 1-1-1-8-1-2-3 | AtAttgattcaAttCCC | 590_9 | -19.01 | 13226 |
| 590 | ATATTGATTCAATTCCC | 4-7-1-3-2 | ATATtgattcaAttcCC | 590_10 | -20.60 | 13226 |
| 590 | ATATTGATTCAATTCCC | 3-1-1-7-1-2-2 | ATAtTgattcaaTtcCC | 590_11 | -20.26 | 13226 |
| 590 | ATATTGATTCAATTCCC | 1-3-1-8-4 | AtatTgattcaatTCCC | 590_12 | -20.37 | 13226 |
| 590 | ATATTGATTCAATTCCC | 2-1-1-10-3 | ATaTtgattcaattCCC | 590_13 | -20.71 | 13226 |
| 590 | ATATTGATTCAATTCCC | 2-2-1-9-3 | ATatTgattcaattCCC | 590_14 | -21.06 | 13226 |
| 590 | ATATTGATTCAATTCCC | 1-1-3-10-2 | AtATTgattcaattcCC | 590_15 | -18.87 | 13226 |
| 590 | ATATTGATTCAATTCCC | 2-2-1-6-2-2-2 | ATatTgattcaATtcCC | 590_16 | -20.26 | 13226 |
| 590 | ATATTGATTCAATTCCC | 3-8-1-1-4 | ATAttgattcaAtTCCC | 590_17 | -22.71 | 13226 |
| 590 | ATATTGATTCAATTCCC | 1-1-3-6-1-2-3 | AtATTgattcaAttCCC | 590_18 | -21.57 | 13226 |
| 590 | ATATTGATTCAATTCCC | 1-1-1-1-1-7-5 | AtAtTgattcaaTTCCC | 590_19 | -21.42 | 13226 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 590 | ATATTGATTCAATTCCC | 2-1-1-8-1-1-3 | ATaTtgattcaaTtCCC | 590_20 | -21.15 | 13226 |
| 591 | GCACATTCTTTCTATACCT | 1-1-1-1-1-12-2 | GcAcAttctttctatacCT | 591_1 | -21.27 | 15113 |
| 591 | GCACATTCTTTCTATACCT | 1-3-1-12-2 | GcacAttctttctatacCT | 591_2 | -21.12 | 15113 |
| 592 | GCACATTCTTTCTATACC | 1-12-1-2-2 | GcacattctttctAtaCC | 592_1 | -20.07 | 15114 |
| 592 | GCACATTCTTTCTATACC | 1-1-1-1-1-11-2 | GcAcAttctttctataCC | 592_2 | -20.17 | 15114 |
| 592 | GCACATTCTTTCTATACC | 1-3-1-11-2 | GcacAttctttctataCC | 592_3 | -20.02 | 15114 |
| 592 | GCACATTCTTTCTATACC | 1-1-2-11-3 | GcACattctttctatACC | 592_4 | -21.80 | 15114 |
| 592 | GCACATTCTTTCTATACC | 1-1-1-1-2-7-1-1-3 | GcAcATctttctAtACC | 592_5 | -22.11 | 15114 |
| 592 | GCACATTCTTTCTATACC | 1-1-1-1-2-7-1-2-2 | GcAcATctttctAtaCC | 592_6 | -21.51 | 15114 |
| 592 | GCACATTCTTTCTATACC | 1-15-2 | GcacattctttctataCC | 592_7 | -19.97 | 15114 |
| 592 | GCACATTCTTTCTATACC | 1-4-1-9-3 | GcacaTctttctatACC | 592_8 | -21.01 | 15114 |
| 592 | GCACATTCTTTCTATACC | 1-4-1-10-2 | GcacaTctttctataCC | 592_9 | -20.41 | 15114 |
| 592 | GCACATTCTTTCTATACC | 2-11-1-2-2 | GCacattctttctAtaCC | 592_10 | -22.39 | 15114 |
| 592 | GCACATTCTTTCTATACC | 1-1-1-1-1-8-1-2-2 | GcAcAttctttctAtaCC | 592_11 | -20.27 | 15114 |
| 592 | GCACATTCTTTCTATACC | 1-3-1-9-1-1-2 | GcacAttctttctaTaCC | 592_12 | -20.89 | 15114 |
| 592 | GCACATTCTTTCTATACC | 1-1-1-1-1-10-3 | GcAcAttctttctatACC | 592_13 | -20.77 | 15114 |
| 592 | GCACATTCTTTCTATACC | 1-1-1-2-1-10-2 | GcAcaTctttctataCC | 592_14 | -20.56 | 15114 |
| 593 | TTATTTCCATTTATTTTCA | 1-1-1-1-8-3-1-2 | TtAtTtccatttaTTTtCA | 593_1 | -19.10 | 15563 |
| 593 | TTATTTCCATTTATTTTCA | 1-2-2-7-1-1-1-3 | TtaTTccatttAtTtTCA | 593_2 | -19.27 | 15563 |
| 593 | TTATTTCCATTTATTTTCA | 2-2-1-8-1-1-1-2 | TTatTtccatttaTtTtCA | 593_3 | -18.92 | 15563 |
| 593 | TTATTTCCATTTATTTTCA | 1-1-2-9-1-2-3 | TtATttccatttaTtttTCA | 593_4 | -19.41 | 15563 |
| 594 | TTTATTTCCATTTATTTTCA | 1-1-1-11-1-2-3 | TtTatttccatttaTttTCA | 594_1 | -19.80 | 15563 |
| 594 | TTTATTTCCATTTATTTTCA | 1-4-1-7-1-1-1-2-2 | TttatTtccatttAtTttCA | 594_2 | -18.34 | 15563 |
| 594 | TTTATTTCCATTTATTTTCA | 1-3-2-9-2-1-2 | TttaTTtccatttatTTtCA | 594_3 | -20.01 | 15563 |
| 594 | TTTATTTCCATTTATTTTCA | 2-1-1-1-1-8-1-1-1-2 | TTTAtTtccatttaTtTtCA | 594_4 | -19.60 | 15563 |
| 595 | ATTTATTTCCATTTATTTTC | 1-1-1-2-1-8-3-1-2 | AtTtaTttccatttATTtTC | 595_1 | -19.05 | 15564 |
| 595 | ATTTATTTCCATTTATTTTC | 1-3-2-7-1-3-3 | AtttATttccattTattTTC | 595_2 | -19.03 | 15564 |
| 595 | ATTTATTTCCATTTATTTTC | 1-1-2-10-1-2-3 | AtTTatttccatttAttTTC | 595_3 | -18.60 | 15564 |
| 595 | ATTTATTTCCATTTATTTTC | 2-1-1-1-1-8-1-1-1-2 | ATtTaTttccattt AtTtTC | 595_4 | -18.96 | 15564 |
| 596 | TTTATTTCCATTTATTTTC | 1-1-1-1-8-2-1-3 | TtTaTttccatttATtTTC | 596_1 | -18.66 | 15564 |
| 596 | TTTATTTCCATTTATTTTC | 3-2-1-7-3-1-2 | TTTatTtccatttATTtTC | 596_2 | -19.84 | 15564 |
| 596 | TTTATTTCCATTTATTTTC | 2-2-2-7-1-1-4 | TTtaTTtccatttAtTTTC | 596_3 | -19.12 | 15564 |
| 596 | TTTATTTCCATTTATTTTC | 5-7-1-3-3 | TTTATttccattTattTTC | 596_4 | -21.30 | 15564 |
| 597 | CCATTTATTTCCATTTATTT | 1-1-1-11-2-2-2 | CcAtttatttccatTTatTT | 597_1 | -19.89 | 15566 |
| 597 | CCATTTATTTCCATTTATTT | 1-3-1-9-1-1-1-2 | CcatTtatttccatTtAtTT | 597_2 | -19.00 | 15566 |
| 597 | CCATTTATTTCCATTTATTT | 1-1-1-2-1-8-1-2-3 | CcAttTatttccatTtaTTT | 597_3 | -20.33 | 15566 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 597 | CCATTTATTTCCATTTATTT | 1-2-2-1-1-11-2 | CcaTTTAtttccatttatTT | 597_4 | −19.64 | 15566 |
| 598 | TCCATTTATTTCCATTTATT | 2-11-2-3-2 | TCcatttatttccATttaTT | 598_1 | −21.22 | 15567 |
| 598 | TCCATTTATTTCCATTTATT | 2-2-1-8-1-1-1-2-2 | TCcaTttatttccAtTtaTT | 598_2 | −20.71 | 15567 |
| 598 | TCCATTTATTTCCATTTATT | 1-1-2-9-1-4-2 | TcCAtttatttccAtttaTT | 598_3 | −20.63 | 15567 |
| 598 | TCCATTTATTTCCATTTATT | 2-1-1-1-1-11-3 | TCcAtTtatttccatttATT | 598_4 | −21.18 | 15567 |
| 599 | TCCATTTATTTCCATTTAT | 2-11-2-2-2 | TCcatttatttccATttAT | 599_1 | −20.30 | 15568 |
| 599 | TCCATTTATTTCCATTTAT | 2-2-1-8-1-1-1-1-2 | TCcaTttatttccAtTTAT | 599_2 | −19.80 | 15568 |
| 599 | TCCATTTATTTCCATTTAT | 1-1-2-9-1-3-2 | TcCAtttatttccAtttAT | 599_3 | −19.72 | 15568 |
| 599 | TCCATTTATTTCCATTTAT | 1-1-1-1-2-7-1-3-2 | TcCaTTtatttccAtttAT | 599_4 | −19.50 | 15568 |
| 600 | TTCCATTTATTTCCATTTAT | 1-1-1-2-1-8-1-1-1-2 | TtCcaTttatttccAtTtAT | 600_1 | −20.12 | 15568 |
| 600 | TTCCATTTATTTCCATTTAT | 1-3-1-10-2-1-2 | TtccAtttatttccaTTTAT | 600_2 | −19.86 | 15568 |
| 600 | TTCCATTTATTTCCATTTAT | 1-1-1-3-1-7-1-3-2 | TtCcatTtatttccAtttAT | 600_3 | −19.68 | 15568 |
| 600 | TTCCATTTATTTCCATTTAT | 1-1-1-1-2-8-1-3-2 | TtCcATttatttccAtttAT | 600_4 | −20.68 | 15568 |
| 601 | TTTCCATTTATTTCCATTTA | 1-4-1-7-1-2-1-1-2 | TttccAtttatttCcaTtTA | 601_1 | −20.53 | 15569 |
| 601 | TTTCCATTTATTTCCATTTA | 2-2-1-12-3 | TTtcCatttatttccatTTA | 601_2 | −21.47 | 15569 |
| 601 | TTTCCATTTATTTCCATTTA | 1-2-1-2-1-8-1-2-2 | TttCcaTttatttccAttTA | 601_3 | −20.53 | 15569 |
| 601 | TTTCCATTTATTTCCATTTA | 1-4-1-9-1-2-2 | TttccAtttatttccAttTA | 601_4 | −19.37 | 15569 |
| 602 | CTTTCCATTTATTTCCATT | 1-11-1-1-1-1-3 | CtttccatttatTtCcATT | 602_1 | −21.20 | 15571 |
| 602 | CTTTCCATTTATTTCCATT | 2-2-1-9-1-2-2 | CTttCcatttatttCcaTT | 602_2 | −22.00 | 15571 |
| 602 | CTTTCCATTTATTTCCATT | 1-4-1-9-1-1-2 | CtttcCatttatttcCaTT | 602_3 | −20.42 | 15571 |
| 602 | CTTTCCATTTATTTCCATT | 1-3-1-11-3 | CtttCcatttatttccATT | 602_4 | −20.89 | 15571 |
| 603 | ATCTTTCCATTTATTTCCAT | 1-2-1-12-1-1-2 | AtcTttccatttatttCcAT | 603_1 | −21.24 | 15572 |
| 603 | ATCTTTCCATTTATTTCCAT | 1-3-1-1-1-7-1-3-2 | AtctTtCcatttatTtccAT | 603_2 | −21.33 | 15572 |
| 603 | ATCTTTCCATTTATTTCCAT | 1-5-1-6-1-4-2 | AtctttCcatttaTttccAT | 603_3 | −21.16 | 15572 |
| 603 | ATCTTTCCATTTATTTCCAT | 1-16-3 | AtctttccatttatttcCAT | 603_4 | −21.95 | 15572 |
| 604 | TCTTTCCATTTATTTCCAT | 2-13-1-1-2 | TCtttccatttatttCcAT | 604_1 | −21.57 | 15572 |
| 604 | TCTTTCCATTTATTTCCAT | 1-2-1-1-1-7-1-1-1-2 | TctTcCatttatTtCcAT | 604_2 | −21.35 | 15572 |
| 604 | TCTTTCCATTTATTTCCAT | 2-14-3 | TCtttccatttatttccAT | 604_3 | −22.80 | 15572 |
| 604 | TCTTTCCATTTATTTCCAT | 2-3-1-11-2 | TCtttCcatttatttccAT | 604_4 | −21.57 | 15572 |
| 605 | ATCTTTCCATTTATTTCCA | 1-2-1-10-1-2-2 | AtcTttccatttatTtcCA | 605_1 | −20.70 | 15573 |
| 605 | ATCTTTCCATTTATTTCCA | 1-3-1-8-1-3-2 | AtctTtccatttaTttcCA | 605_2 | −20.63 | 15573 |
| 605 | ATCTTTCCATTTATTTCCA | 1-1-1-14-2 | AtCtttccatttatttcCA | 605_3 | −20.86 | 15573 |
| 605 | ATCTTTCCATTTATTTCCA | 1-4-1-9-1-1-2 | AtcttTccatttatttcCA | 605_4 | −20.63 | 15573 |
| 606 | TATCTTTCCATTTATTTCCA | 1-4-1-8-2-2-2 | TatctTtccatttaTTtcCA | 606_1 | −22.54 | 15573 |
| 606 | TATCTTTCCATTTATTTCCA | 2-16-2 | TAtctttccatttatttcCA | 606_2 | −22.12 | 15573 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 606 | TATCTTTCCATTTATTTCCA | 1-2-1-14-2 | TatCtttccatttatttcCA | 606_3 | -21.97 | 15573 |
| 606 | TATCTTTCCATTTATTTCCA | 1-17-2 | TatctttccatttatttcCA | 606_4 | -20.99 | 15573 |
| 607 | TATCTTTCCATTTATTTCC | 2-12-1-2-2 | TAtctttccatttaTttCC | 607_1 | -21.63 | 15574 |
| 607 | TATCTTTCCATTTATTTCC | 1-2-1-13-2 | TatCtttccatttatttCC | 607_2 | -21.04 | 15574 |
| 607 | TATCTTTCCATTTATTTCC | 1-2-2-12-2 | TatCTttccatttatttCC | 607_3 | -22.23 | 15574 |
| 607 | TATCTTTCCATTTATTTCC | 1-4-1-9-1-1-2 | TatctTtccatttatTtCC | 607_4 | -20.66 | 15574 |
| 608 | AAATCTCAACTACCATTTTT | 1-1-1-3-1-7-3-1-2 | AaAtctCaactaccATTtTT | 608_1 | -19.53 | 25248 |
| 608 | AAATCTCAACTACCATTTTT | 3-1-1-9-2-1-3 | AAAtCtcaactaccATtTTT | 608_2 | -20.58 | 25248 |
| 608 | AAATCTCAACTACCATTTTT | 1-3-1-8-1-1-5 | AaatCtcaactacCaTTTTT | 608_3 | -20.56 | 25248 |
| 608 | AAATCTCAACTACCATTTTT | 1-1-1-2-1-7-2-2-3 | AaAtCtcaactacCAttTTT | 608_4 | -20.20 | 25248 |
| 608 | AAATCTCAACTACCATTTTT | 1-3-1-1-1-6-1-1-1-2-2 | AaatCtCaactacCaTttTT | 608_5 | -19.10 | 25248 |
| 608 | AAATCTCAACTACCATTTTT | 2-3-2-6-1-2-4 | AAatcTCaactacCatTTTT | 608_6 | -21.04 | 25248 |
| 608 | AAATCTCAACTACCATTTTT | 2-1-2-1-1-7-1-3-2 | AAaTCtCaactaccAtttTT | 608_7 | -19.79 | 25248 |
| 608 | AAATCTCAACTACCATTTTT | 1-1-3-11-1-1-2 | AaAtCtcaactaccatTtTT | 608_8 | -19.97 | 25248 |
| 608 | AAATCTCAACTACCATTTTT | 3-1-1-1-1-10-3 | AAAtCtCaactaccattTTT | 608_9 | -19.95 | 25248 |
| 609 | AAAATCTCAACTACCATTTT | 1-12-4-1-2 | AaaatctcaactaCCAtTTT | 609_1 | -21.31 | 25249 |
| 609 | AAAATCTCAACTACCATTTT | 3-11-2-1-3 | AAAatctcaactacCAtTTT | 609_2 | -19.57 | 25249 |
| 609 | AAAATCTCAACTACCATTTT | 2-1-1-1-1-8-2-1-3 | AAaAtCtcaactacCAtTTT | 609_3 | -20.33 | 25249 |
| 609 | AAAATCTCAACTACCATTTT | 1-1-4-9-1-2-2 | AaAATCtcaactaccAttTT | 609_4 | -19.46 | 25249 |
| 609 | AAAATCTCAACTACCATTTT | 1-1-2-2-1-7-2-2-2 | AaAAtCtcaactacCAttTT | 609_5 | -19.13 | 25249 |
| 609 | AAAATCTCAACTACCATTTT | 4-1-1-7-1-2-4 | AAAAtCtcaactaCcaTTTT | 609_6 | -20.75 | 25249 |
| 609 | AAAATCTCAACTACCATTTT | 1-1-1-2-1-8-1-1-4 | AaAatCtcaactacCaTTTT | 609_7 | -19.30 | 25249 |
| 609 | AAAATCTCAACTACCATTTT | 1-2-3-7-1-1-1-3 | AaaATCtcaactaCcAtTTT | 609_8 | -20.51 | 25249 |
| 609 | AAAATCTCAACTACCATTTT | 2-2-2-10-1-1-2 | AAaaTCtcaactaccaTtTT | 609_9 | -18.72 | 25249 |
| 610 | AAAATCTCAACTACCATTT | 1-4-1-6-4-1-2 | AaaatCtcaactACCAtTT | 610_1 | -20.63 | 25250 |
| 610 | AAAATCTCAACTACCATTT | 3-10-6 | AAAatctcaactaCCATTT | 610_2 | -21.90 | 25250 |
| 610 | AAAATCTCAACTACCATTT | 6-6-2-2-3 | AAAATCtcaactACcaTTT | 610_3 | -21.46 | 25250 |
| 610 | AAAATCTCAACTACCATTT | 2-2-2-7-2-1-3 | AAaaTCtcaactaCCaTTT | 610_4 | -21.18 | 25250 |
| 610 | AAAATCTCAACTACCATTT | 6-7-2-2-2 | AAAATCtcaactaCCatTT | 610_5 | -22.10 | 25250 |
| 610 | AAAATCTCAACTACCATTT | 2-1-1-1-1-8-5 | AAaAtCtcaactacCATTT | 610_6 | -20.27 | 25250 |
| 610 | AAAATCTCAACTACCATTT | 1-1-1-1-2-8-5 | AaAaTCtcaactacCATTT | 610_7 | -20.88 | 25250 |
| 610 | AAAATCTCAACTACCATTT | 1-1-2-1-1-8-2-1-2 | AaAAtCtcaactacCAtTT | 610_8 | -18.51 | 25250 |
| 610 | AAAATCTCAACTACCATTT | 6-9-4 | AAAATCtcaactaccATTT | 610_9 | -20.94 | 25250 |
| 611 | GAAAATCTCAACTACCATT | 1-1-3-7-1-2-4 | GaAAAtctcaacTacCATT | 611_1 | -20.48 | 25251 |
| 611 | GAAAATCTCAACTACCATT | 1-1-2-8-1-1-1-3 | GaAAatctcaacTaCcATT | 611_2 | -18.75 | 25251 |
| 611 | GAAAATCTCAACTACCATT | 3-1-1-10-4 | GAAaAtctcaactacCATT | 611_3 | -20.73 | 25251 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 611 | GAAAATCTCAACTACCATT | 2-1-2-10-4 | GAaAAtctcaactacCATT | 611_4 | -20.73 | 25251 |
| 611 | GAAAATCTCAACTACCATT | 2-2-1-7-1-4-2 | GAaaAtctcaacTaccaTT | 611_5 | -18.28 | 25251 |
| 611 | GAAAATCTCAACTACCATT | 2-12-5 | GAaaatctcaactaCCATT | 611_6 | -22.25 | 25251 |
| 611 | GAAAATCTCAACTACCATT | 4-10-2-1-2 | GAAAtctcaactaCCaTT | 611_7 | -21.06 | 25251 |
| 611 | GAAAATCTCAACTACCATT | 4-10-1-1-3 | GAAAtctcaactaCcATT | 611_8 | -19.73 | 25251 |
| 611 | GAAAATCTCAACTACCATT | 5-12-2 | GAAAAtctcaactaccaTT | 611_9 | -18.61 | 25251 |
| 612 | TGAAAATCTCAACTACCAT | 1-4-1-6-1-1-2-1-2 | TgaaaAtctcaaCtACcAT | 612_1 | -18.43 | 25252 |
| 612 | TGAAAATCTCAACTACCAT | 2-1-2-7-1-2-1-1-2 | TGaAAatctcaaCtaCcAT | 612_2 | -19.46 | 25252 |
| 612 | TGAAAATCTCAACTACCAT | 1-1-2-8-1-2-1-1-2 | TgAAaatctcaaCtaCcAT | 612_3 | -18.58 | 25252 |
| 612 | TGAAAATCTCAACTACCAT | 1-2-1-1-1-6-1-3-3 | TgaAaAtctcaaCtacCAT | 612_4 | -19.40 | 25252 |
| 612 | TGAAAATCTCAACTACCAT | 1-3-2-10-3 | TgaaAAtctcaactacCAT | 612_5 | -18.60 | 25252 |
| 612 | TGAAAATCTCAACTACCAT | 1-11-1-2-4 | TgaaaatctcaaCtaCCAT | 612_6 | -21.11 | 25252 |
| 612 | TGAAAATCTCAACTACCAT | 3-1-2-6-1-4-2 | TGAaAatctcaaCtaccAT | 612_7 | -20.39 | 25252 |
| 612 | TGAAAATCTCAACTACCAT | 1-1-1-1-1-7-1-3-3 | TgAaAatctcaaCtacCAT | 612_8 | -19.60 | 25252 |
| 612 | TGAAAATCTCAACTACCAT | 4-12-3 | TGAAaatctcaactacCAT | 612_9 | -21.07 | 25252 |
| 613 | ATCATTCTCAACAATTAAA | 4-8-7 | ATCAttctcaacAATTAAA | 613_1 | -20.89 | 30599 |
| 613 | ATCATTCTCAACAATTAAA | 1-1-4-6-7 | AtCATTctcaacAATTAAA | 613_2 | -21.09 | 30599 |
| 613 | ATCATTCTCAACAATTAAA | 5-7-2-1-1-1-2 | ATCATtctcaacAAtTaAA | 613_3 | -19.03 | 30599 |
| 613 | ATCATTCTCAACAATTAAA | 5-8-2-2-2 | ATCATtctcaacaATtaAA | 613_4 | -19.28 | 30599 |
| 613 | ATCATTCTCAACAATTAAA | 4-1-1-8-5 | ATCAtTctcaacaaTTAAA | 613_5 | -19.86 | 30599 |
| 613 | ATCATTCTCAACAATTAAA | 5-7-4-1-2 | ATCATtctcaacAATTaAA | 613_6 | -20.79 | 30599 |
| 613 | ATCATTCTCAACAATTAAA | 4-8-1-1-5 | ATCAttctcaacAaTTAAA | 613_7 | -19.56 | 30599 |
| 613 | ATCATTCTCAACAATTAAA | 1-1-4-6-1-1-5 | AtCATTctcaacAaTTAAA | 613_8 | -19.76 | 30599 |
| 613 | ATCATTCTCAACAATTAAA | 4-1-1-7-3-1-2 | ATCAtTctcaacaATTaAA | 613_9 | -19.64 | 30599 |
| 613 | ATCATTCTCAACAATTAAA | 5-8-1-1-4 | ATCATtctcaacaAtTAAA | 613_10 | -20.11 | 30599 |
| 614 | ATCATTCTCAACAATTAA | 4-8-6 | ATCAttctcaacAATTAA | 614_1 | -20.14 | 30600 |
| 614 | ATCATTCTCAACAATTAA | 1-1-4-6-6 | AtCATTctcaacAATTAA | 614_2 | -20.34 | 30600 |
| 614 | ATCATTCTCAACAATTAA | 5-8-1-1-3 | ATCATtctcaacaAtTAA | 614_3 | -19.36 | 30600 |
| 614 | ATCATTCTCAACAATTAA | 4-8-1-1-4 | ATCAttctcaacAaTTAA | 614_4 | -18.81 | 30600 |
| 614 | ATCATTCTCAACAATTAA | 5-8-5 | ATCATtctcaacaATTAA | 614_5 | -21.12 | 30600 |
| 614 | ATCATTCTCAACAATTAA | 5-7-1-2-3 | ATCATtctcaacAatTAA | 614_6 | -19.11 | 30600 |
| 614 | ATCATTCTCAACAATTAA | 3-10-5 | ATCattctcaacaATTAA | 614_7 | -18.40 | 30600 |
| 614 | ATCATTCTCAACAATTAA | 4-9-1-1-3 | ATCAttctcaacaAtTAA | 614_8 | -18.11 | 30600 |
| 614 | ATCATTCTCAACAATTAA | 4-1-1-8-4 | ATCAtTctcaacaaTTAA | 614_9 | -19.11 | 30600 |
| 614 | ATCATTCTCAACAATTAA | 1-1-3-9-4 | AtCATtctcaacaaTTAA | 614_10 | -18.05 | 30600 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 615 | GATCATTCTCAACAATTAA | 2-3-1-6-2-1-4 | GAtcaTtctcaaCAaTTAA | 615_1 | -20.54 | 30600 |
| 615 | GATCATTCTCAACAATTAA | 1-2-2-7-1-2-4 | GatCAttctcaaCaaTTAA | 615_2 | -19.04 | 30600 |
| 615 | GATCATTCTCAACAATTAA | 2-1-3-6-3-2-2 | GAtCATtctcaaCAAttAA | 615_3 | -21.29 | 30600 |
| 615 | GATCATTCTCAACAATTAA | 2-1-2-8-2-1-3 | GAtCAttctcaacAAtTAA | 615_4 | -19.70 | 30600 |
| 615 | GATCATTCTCAACAATTAA | 5-8-1-1-1-1-2 | GATCAttctcaacAaTtAA | 615_5 | -19.79 | 30600 |
| 615 | GATCATTCTCAACAATTAA | 4-8-3-2-2 | GATCattctcaaCAAttAA | 615_6 | -20.50 | 30600 |
| 615 | GATCATTCTCAACAATTAA | 1-2-3-6-2-2-3 | GatCATtctcaaCAatTAA | 615_7 | -20.82 | 30600 |
| 615 | GATCATTCTCAACAATTAA | 2-2-2-6-1-1-5 | GAtcATtctcaCaATTAA | 615_8 | -21.04 | 30600 |
| 615 | GATCATTCTCAACAATTAA | 2-1-1-8-1-2-4 | GAtCattctcaaCaaTTAA | 615_9 | -19.28 | 30600 |
| 615 | GATCATTCTCAACAATTAA | 1-1-3-9-1-1-3 | GaTCAttctcaacaAtTAA | 615_10 | -18.85 | 30600 |
| 616 | AGATCATTCTCAACAATTA | 1-1-1-2-1-7-3-1-2 | AgAtcAttctcaaCAAtTA | 616_1 | -19.10 | 30601 |
| 616 | AGATCATTCTCAACAATTA | 1-3-1-8-2-1-3 | AgatCattctcaaCAaTTA | 616_2 | -19.65 | 30601 |
| 616 | AGATCATTCTCAACAATTA | 1-3-2-6-1-1-1-2-2 | AgatCAttctcAcAatTA | 616_3 | -18.49 | 30601 |
| 616 | AGATCATTCTCAACAATTA | 1-1-1-1-2-11-2 | AgAtCAttctcaacaatTA | 616_4 | -18.49 | 30601 |
| 616 | AGATCATTCTCAACAATTA | 1-1-1-2-1-9-4 | AgAtcAttctcaacaATTA | 616_5 | -18.49 | 30601 |
| 616 | AGATCATTCTCAACAATTA | 1-3-2-6-1-1-5 | AgatCAttctcAcAATTA | 616_6 | -20.76 | 30601 |
| 616 | AGATCATTCTCAACAATTA | 2-2-1-8-3-1-2 | AGatCattctcaaCAAtTA | 616_7 | -20.47 | 30601 |
| 616 | AGATCATTCTCAACAATTA | 3-2-1-7-1-2-3 | AGAtcAttctcaaCaaTTA | 616_8 | -20.51 | 30601 |
| 616 | AGATCATTCTCAACAATTA | 1-2-3-7-1-3-2 | AgaTCAttctcaaCaatTA | 616_9 | -19.80 | 30601 |
| 616 | AGATCATTCTCAACAATTA | 1-1-1-1-2-8-2-1-2 | AgAtCAttctcaacAAtTA | 616_10 | -19.08 | 30601 |
| 617 | GATCATTCTCAACAATTA | 2-3-1-6-6 | GAtcaTtctcaaCAATTA | 617_1 | -21.11 | 30601 |
| 617 | GATCATTCTCAACAATTA | 2-1-2-8-5 | GAtCAttctcaacAATTA | 617_2 | -20.71 | 30601 |
| 617 | GATCATTCTCAACAATTA | 2-2-2-6-2-2-2 | GAtcATtctcaaCAatTA | 617_3 | -19.70 | 30601 |
| 617 | GATCATTCTCAACAATTA | 1-1-3-7-1-1-1-1-2 | GaTCAttctcaaCaAtTA | 617_4 | -18.78 | 30601 |
| 617 | GATCATTCTCAACAATTA | 2-1-2-10-3 | GAtCAttctcaacaaTTA | 617_5 | -19.31 | 30601 |
| 617 | GATCATTCTCAACAATTA | 2-1-1-1-6-3-1-2 | GAtCaTtctcaaCAAtTA | 617_6 | -20.02 | 30601 |
| 617 | GATCATTCTCAACAATTA | 2-1-2-7-2-2-2 | GAtCAttctcaCAatTA | 617_7 | -20.53 | 30601 |
| 617 | GATCATTCTCAACAATTA | 2-1-3-6-1-2-3 | GAtCATtctcaaCaaTTA | 617_8 | -21.24 | 30601 |
| 617 | GATCATTCTCAACAATTA | 2-2-1-8-5 | GAtcAttctcaacAATTA | 617_9 | -18.63 | 30601 |
| 617 | GATCATTCTCAACAATTA | 1-1-3-9-1-1-2 | GaTCAttctcaacaAtTA | 617_10 | -18.10 | 30601 |
| 618 | AGATCATTCTCAACAATT | 1-3-2-6-6 | AgatCAttctcaACAATT | 618_1 | -21.03 | 30602 |
| 618 | AGATCATTCTCAACAATT | 1-1-1-1-2-7-5 | AgAtCAttctcaaCAATT | 618_2 | -20.70 | 30602 |
| 618 | AGATCATTCTCAACAATT | 1-1-4-6-1-3-2 | AgATCAttctcaAcaaTT | 618_3 | -19.56 | 30602 |
| 618 | AGATCATTCTCAACAATT | 3-1-1-9-4 | AGAtCattctcaacAATT | 618_4 | -19.61 | 30602 |
| 618 | AGATCATTCTCAACAATT | 2-1-3-10-2 | AGaTCAttctcaacaaTT | 618_5 | -19.09 | 30602 |
| 618 | AGATCATTCTCAACAATT | 1-2-3-6-1-3-2 | AgaTCAttctcaAcaaTT | 618_6 | -18.25 | 30602 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 618 | AGATCATTCTCAACAATT | 2-2-2-7-2-1-2 | AGatCAttctcaaCAaTT | 618_7 | -20.14 | 30602 |
| 618 | AGATCATTCTCAACAATT | 1-1-1-1-2-7-1-1-3 | AgAtCAttctcaaCaATT | 618_8 | -19.02 | 30602 |
| 618 | AGATCATTCTCAACAATT | 1-2-3-8-4 | AgaTCAttctcaacAATT | 618_9 | -19.23 | 30602 |
| 618 | AGATCATTCTCAACAATT | 3-1-1-10-3 | AGAtCattctcaacaATT | 618_10 | -19.34 | 30602 |
| 619 | GATCATTCTCAACAATT | 2-1-2-6-6 | GAtCAttctcaACAATT | 619_1 | -21.40 | 30602 |
| 619 | GATCATTCTCAACAATT | 1-1-3-7-5 | GaTCAttctcaaCAATT | 619_2 | -19.99 | 30602 |
| 619 | GATCATTCTCAACAATT | 5-7-1-2-2 | GATCAttctcaaCaaTT | 619_3 | -19.69 | 30602 |
| 619 | GATCATTCTCAACAATT | 5-6-1-1-4 | GATCAttctcaAcAATT | 619_4 | -20.83 | 30602 |
| 619 | GATCATTCTCAACAATT | 2-1-2-7-5 | GAtCAttctcaaCAATT | 619_5 | -20.57 | 30602 |
| 619 | GATCATTCTCAACAATT | 5-6-1-3-2 | GATCAttctcaAcaaTT | 619_6 | -19.43 | 30602 |
| 619 | GATCATTCTCAACAATT | 4-8-5 | GATCattctcaaCAATT | 619_7 | -21.04 | 30602 |
| 619 | GATCATTCTCAACAATT | 1-1-3-7-2-1-2 | GaTCAttctcaaCAaTT | 619_8 | -18.67 | 30602 |
| 619 | GATCATTCTCAACAATT | 5-7-1-1-3 | GATCAttctcaaCaATT | 619_9 | -20.82 | 30602 |
| 619 | GATCATTCTCAACAATT | 2-1-2-8-4 | GAtCAttctcaacAATT | 619_10 | -18.48 | 30602 |
| 620 | AAGATCATTCTCAACAAT | 4-1-1-6-1-1-4 | AAGAtCattctcAaCAAT | 620_1 | -20.71 | 30603 |
| 620 | AAGATCATTCTCAACAAT | 4-9-5 | AAGAtcattctcaACAAT | 620_2 | -20.79 | 30603 |
| 620 | AAGATCATTCTCAACAAT | 2-2-2-6-6 | AAgaTCattctcAACAAT | 620_3 | -19.88 | 30603 |
| 620 | AAGATCATTCTCAACAAT | 4-1-1-7-2-1-2 | AAGAtCattctcaACaAT | 620_4 | -19.77 | 30603 |
| 620 | AAGATCATTCTCAACAAT | 2-1-3-8-4 | AAgATCattctcaaCAAT | 620_5 | -20.10 | 30603 |
| 620 | AAGATCATTCTCAACAAT | 4-1-1-6-2-2-2 | AAGAtCattctcAAcaAT | 620_6 | -18.96 | 30603 |
| 620 | AAGATCATTCTCAACAAT | 3-1-2-6-1-1-4 | AAGaTCattctcAaCAAT | 620_7 | -20.12 | 30603 |
| 620 | AAGATCATTCTCAACAAT | 2-1-3-6-1-1-4 | AAgATCattctcAaCAAT | 620_8 | -20.17 | 30603 |
| 620 | AAGATCATTCTCAACAAT | 1-1-1-2-1-7-5 | AaGatCattctcaACAAT | 620_9 | -18.21 | 30603 |
| 620 | AAGATCATTCTCAACAAT | 4-1-1-8-4 | AAGAtCattctcaaCAAT | 620_10 | -20.63 | 30603 |
| 621 | AAAGATCATTCTCAACAA | 1-1-1-9-6 | AaAgatcattctCAACAA | 621_1 | -18.13 | 30604 |
| 621 | AAAGATCATTCTCAACAA | 1-1-3-7-2-1-3 | AaAGAtcattctCAaCAA | 621_2 | -20.08 | 30604 |
| 621 | AAAGATCATTCTCAACAA | 1-3-2-6-2-1-3 | AaagATcattctCAaCAA | 621_3 | -18.11 | 30604 |
| 621 | AAAGATCATTCTCAACAA | 1-2-2-7-1-1-4 | AaaGAtcattctCaACAA | 621_4 | -18.07 | 30604 |
| 621 | AAAGATCATTCTCAACAA | 5-10-3 | AAAGAtcattctcaaCAA | 621_5 | -18.65 | 30604 |
| 621 | AAAGATCATTCTCAACAA | 1-1-3-7-3-1-2 | AaAGAtcattctCAAcAA | 621_6 | -18.59 | 30604 |
| 621 | AAAGATCATTCTCAACAA | 4-8-2-1-3 | AAAGatcattctCAaCAA | 621_7 | -19.10 | 30604 |
| 621 | AAAGATCATTCTCAACAA | 3-1-1-7-2-1-3 | AAAGatcattctCAaCAA | 621_8 | -18.35 | 30604 |
| 621 | AAAGATCATTCTCAACAA | 1-1-2-8-2-1-3 | AaAGatcattctCAaCAA | 621_9 | -18.37 | 30604 |
| 621 | AAAGATCATTCTCAACAA | 1-2-2-7-2-1-3 | AaaGAtcattctCAaCAA | 621_10 | -18.74 | 30604 |
| 621 | AAAGATCATTCTCAACAA | 5-7-1-2-3 | AAAGAtcattctCaaCAA | 621_11 | -19.32 | 30604 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 622 | CAAAGATCATTCTCAACA | 1-1-2-8-6 | CaAAgatcattcTCAACA | 622_1 | -20.93 | 30605 |
| 622 | CAAAGATCATTCTCAACA | 2-1-1-9-5 | CAaAgatcattctCAACA | 622_2 | -20.68 | 30605 |
| 622 | CAAAGATCATTCTCAACA | 1-4-1-7-5 | CaaagAtcattctCAACA | 622_3 | -18.86 | 30605 |
| 622 | CAAAGATCATTCTCAACA | 4-1-1-7-1-2-2 | CAAAgAtcattctCaaCA | 622_4 | -19.40 | 30605 |
| 622 | CAAAGATCATTCTCAACA | 3-1-2-10-2 | CAAaGAtcattctcaaCA | 622_5 | -19.67 | 30605 |
| 622 | CAAAGATCATTCTCAACA | 4-8-2-2-2 | CAAAgatcattcTCaaCA | 622_6 | -20.10 | 30605 |
| 622 | CAAAGATCATTCTCAACA | 1-1-2-1-1-7-5 | CaAAgAtcattctCAACA | 622_7 | -20.23 | 30605 |
| 622 | CAAAGATCATTCTCAACA | 2-1-1-9-2-1-2 | CAaAgatcattctCAaCA | 622_8 | -19.66 | 30605 |
| 622 | CAAAGATCATTCTCAACA | 3-2-1-7-1-1-3 | CAAagAtcattctCaACA | 622_9 | -19.21 | 30605 |
| 622 | CAAAGATCATTCTCAACA | 1-3-2-7-1-2-2 | CaaaGAtcattctCaaCA | 622_10 | -18.30 | 30605 |
| 623 | CAAAGATCATTCTCAAC | 3-8-6 | CAAagatcattCTCAAC | 623_1 | -19.95 | 30606 |
| 623 | CAAAGATCATTCTCAAC | 2-1-1-7-6 | CAaAgatcattCTCAAC | 623_2 | -20.23 | 30606 |
| 623 | CAAAGATCATTCTCAAC | 2-2-1-6-6 | CAaaGatcattCTCAAC | 623_3 | -20.15 | 30606 |
| 623 | CAAAGATCATTCTCAAC | 1-2-2-6-6 | CaaAGatcattCTCAAC | 623_4 | -20.00 | 30606 |
| 623 | CAAAGATCATTCTCAAC | 5-6-1-1-4 | CAAAGatcattCtCAAC | 623_5 | -20.35 | 30606 |
| 623 | CAAAGATCATTCTCAAC | 4-7-3-1-2 | CAAAgatcattCTCaAC | 623_6 | -19.28 | 30606 |
| 623 | CAAAGATCATTCTCAAC | 3-1-1-6-1-1-4 | CAAaGatcattCtCAAC | 623_7 | -18.81 | 30606 |
| 623 | CAAAGATCATTCTCAAC | 2-1-1-7-1-1-4 | CAaAgatcattCtCAAC | 623_8 | -18.36 | 30606 |
| 623 | CAAAGATCATTCTCAAC | 1-2-2-6-1-1-4 | CaaAGatcattCtCAAC | 623_9 | -18.12 | 30606 |
| 623 | CAAAGATCATTCTCAAC | 4-8-5 | CAAAgatcattcTCAAC | 623_10 | -19.31 | 30606 |
| 624 | CTCAAAGATCATTCTCA | 1-2-1-7-6 | CtcAaagatcaTTCTCA | 624_1 | -20.57 | 30608 |
| 624 | CTCAAAGATCATTCTCA | 1-1-1-1-7-2-1-2 | CtCaAagatcatTCtCA | 624_2 | -18.69 | 30608 |
| 624 | CTCAAAGATCATTCTCA | 1-1-2-7-1-2-3 | CtCAaagatcaTtcTCA | 624_3 | -19.51 | 30608 |
| 624 | CTCAAAGATCATTCTCA | 3-10-1-1-2 | CTCaaagatcattCtCA | 624_4 | -19.23 | 30608 |
| 624 | CTCAAAGATCATTCTCA | 1-1-3-8-4 | CtCAAagatcattCTCA | 624_5 | -21.26 | 30608 |
| 624 | CTCAAAGATCATTCTCA | 1-1-3-6-1-1-1-2 | CtCAAagatcaTtCtCA | 624_6 | -19.82 | 30608 |
| 624 | CTCAAAGATCATTCTCA | 4-7-1-3-2 | CTCAaagatcaTtctCA | 624_7 | -20.18 | 30608 |
| 624 | CTCAAAGATCATTCTCA | 1-2-2-7-5 | CtcAAagatcatTCTCA | 624_8 | -20.16 | 30608 |
| 624 | CTCAAAGATCATTCTCA | 1-2-8-2-1-2 | CtCAaagatcatTCtCA | 624_9 | -19.83 | 30608 |
| 624 | CTCAAAGATCATTCTCA | 3-10-4 | CTCaaagatcattCTCA | 624_10 | -21.11 | 30608 |
| 625 | TACACTTAATTATACTTCCA | 1-2-1-1-1-7-2-3-2 | TacActtaattatACttcCA | 625_1 | -20.33 | 30666 |
| 625 | TACACTTAATTATACTTCCA | 1-2-1-2-1-6-1-4-2 | TacActTaattatActtcCA | 625_2 | -19.15 | 30666 |
| 625 | TACACTTAATTATACTTCCA | 1-4-1-7-1-1-1-2-2 | TacacTtaattatAcTtcCA | 625_3 | -19.30 | 30666 |
| 625 | TACACTTAATTATACTTCCA | 1-1-1-2-2-6-1-4-2 | TaCacTTaattatActtcCA | 625_4 | -20.71 | 30666 |
| 625 | TACACTTAATTATACTTCCA | 1-1-1-3-1-8-1-2-2 | TaCactTaattatacTtcCA | 625_5 | -20.00 | 30666 |
| 625 | TACACTTAATTATACTTCCA | 1-2-1-1-1-2-8-1-2-2 | TacActTaattatacTtcCA | 625_6 | -20.50 | 30666 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 625 | TACACTTAATTATACTTCCA | 1-2-1-13-3 | TacActtaattatacttCCA | 625_7 | -20.60 | 30666 |
| 625 | TACACTTAATTATACTTCCA | 1-4-1-11-3 | TacacTtaattatacttCCA | 625_8 | -20.96 | 30666 |
| 625 | TACACTTAATTATACTTCCA | 2-1-1-1-1-12-2 | TAcActtaattatacttcCA | 625_9 | -19.97 | 30666 |
| 625 | TACACTTAATTATACTTCCA | 1-1-1-2-1-7-2-3-2 | TaCacTtaattatACttcCA | 625_10 | -20.87 | 30666 |
| 625 | TACACTTAATTATACTTCCA | 1-2-1-1-2-6-1-1-1-2-2 | TacAcTTaattatAcTtcCA | 625_11 | -20.69 | 30666 |
| 625 | TACACTTAATTATACTTCCA | 1-2-1-1-1-9-1-1-3 | TacAcTtaattatacTtCCA | 625_12 | -21.63 | 30666 |
| 625 | TACACTTAATTATACTTCCA | 1-1-1-3-1-10-3 | TaCactTaattatacttCCA | 625_13 | -21.86 | 30666 |
| 625 | TACACTTAATTATACTTCCA | 2-1-2-1-1-11-2 | TAcACtTaattatacttcCA | 625_14 | -21.58 | 30666 |
| 626 | TTACACTTAATTATACTTCC | 1-3-1-1-1-7-2-2-2 | TtacAcTtaattatACttCC | 626_1 | -19.98 | 30667 |
| 626 | TTACACTTAATTATACTTCC | 1-5-1-7-1-1-1-1-2 | TtacacTtaattatAcTtCC | 626_2 | -18.96 | 30667 |
| 626 | TTACACTTAATTATACTTCC | 2-4-1-11-2 | TTacacTtaattatacttCC | 626_3 | -19.49 | 30667 |
| 626 | TTACACTTAATTATACTTCC | 1-5-1-9-4 | TtacacTtaattatacTTCC | 626_4 | -20.26 | 30667 |
| 626 | TTACACTTAATTATACTTCC | 1-1-3-1-8-1-2-2 | TtAcacTtaattataCttCC | 626_5 | -19.43 | 30667 |
| 626 | TTACACTTAATTATACTTCC | 1-1-2-2-1-7-1-3-2 | TtACacTtaattatActtCC | 626_6 | -19.72 | 30667 |
| 626 | TTACACTTAATTATACTTCC | 3-1-1-12-3 | TTAcActtaattatactTCC | 626_7 | -21.33 | 30667 |
| 626 | TTACACTTAATTATACTTCC | 1-1-1-1-1-1-9-1-1-2 | TtAcAcTtaattatacTtCC | 626_8 | -19.10 | 30667 |
| 626 | TTACACTTAATTATACTTCC | 1-2-2-1-1-11-2 | TtaCAcTtaattatacttCC | 626_9 | -20.49 | 30667 |
| 626 | TTACACTTAATTATACTTCC | 1-5-1-7-2-1-3 | TtacacTtaattatACtTCC | 626_10 | -20.82 | 30667 |
| 626 | TTACACTTAATTATACTTCC | 4-2-1-7-1-3-2 | TTACacTtaattatActtCC | 626_11 | -21.99 | 30667 |
| 626 | TTACACTTAATTATACTTCC | 1-1-1-1-3-8-1-2-2 | TtAcACTtaattataCttCC | 626_12 | -21.65 | 30667 |
| 626 | TTACACTTAATTATACTTCC | 2-1-2-11-4 | TTaCActtaattatacTTCC | 626_13 | -23.23 | 30667 |
| 626 | TTACACTTAATTATACTTCC | 2-2-1-1-1-9-1-1-2 | TTacAcTtaattatacTtCC | 626_14 | -20.15 | 30667 |
| 627 | TTTACACTTAATTATACTTC | 2-1-2-8-1-1-5 | TTTACacttaattAtACTTC | 627_1 | -20.02 | 30668 |
| 627 | TTTACACTTAATTATACTTC | 2-3-1-7-4-1-2 | TTtacActtaattATACtTC | 627_2 | -19.89 | 30668 |
| 627 | TTTACACTTAATTATACTTC | 1-2-1-1-1-7-2-1-4 | TttAcActtaattATaCTTC | 627_3 | -19.35 | 30668 |
| 627 | TTTACACTTAATTATACTTC | 1-1-3-8-3-2-2 | TtTACacttaattATActTC | 627_4 | -20.58 | 30668 |
| 627 | TTTACACTTAATTATACTTC | 3-2-1-7-3-1-3 | TTTacActtaattATAcTTC | 627_5 | -20.76 | 30668 |
| 627 | TTTACACTTAATTATACTTC | 1-3-2-7-2-2-3 | TttaCActtaattATAcTTC | 627_6 | -19.58 | 30668 |
| 627 | TTTACACTTAATTATACTTC | 3-2-1-7-2-1-4 | TTTacActtaattATaCTTC | 627_7 | -21.21 | 30668 |
| 627 | TTTACACTTAATTATACTTC | 3-1-1-8-1-2-4 | TTTaCacttaattAtaCTTC | 627_8 | -20.07 | 30668 |
| 627 | TTTACACTTAATTATACTTC | 6-7-1-4-2 | TTTACActtaattAtactTC | 627_9 | -20.56 | 30668 |
| 627 | TTTACACTTAATTATACTTC | 4-1-1-7-4-1-2 | TTTAcActtaattATACtTC | 627_10 | -22.36 | 30668 |
| 627 | TTTACACTTAATTATACTTC | 3-1-1-1-1-6-3-1-3 | TTTaCaCttaattATAcTTC | 627_11 | -22.29 | 30668 |
| 627 | TTTACACTTAATTATACTTC | 2-1-3-7-3-2-2 | TTTACacttaattATActTC | 627_12 | -21.19 | 30668 |
| 627 | TTTACACTTAATTATACTTC | 3-1-2-7-2-1-4 | TTTaCActtaattATaCTTC | 627_13 | -23.30 | 30668 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 627 | TTTACACTTAATTATACTTC | 1-1-4-7-1-2-4 | TtTACActtaattAtaCTTC | 627_14 | -21.94 | 30668 |
| 628 | ATTTACACTTAATTATACTT | 2-1-1-2-1-6-3-1-3 | ATtTacActtaatTATaCTT | 628_1 | -21.21 | 30669 |
| 628 | ATTTACACTTAATTATACTT | 3-1-1-8-2-1-4 | ATTtAcacttaatTAtACTT | 628_2 | -20.27 | 30669 |
| 628 | ATTTACACTTAATTATACTT | 1-1-2-2-1-6-4-1-2 | AtTTacActtaatTATAcTT | 628_3 | -20.33 | 30669 |
| 628 | ATTTACACTTAATTATACTT | 1-3-1-1-1-7-6 | AtttAcActtaattATACTT | 628_4 | -19.30 | 30669 |
| 628 | ATTTACACTTAATTATACTT | 2-2-2-7-3-2-2 | ATttACacttaatTATacTT | 628_5 | -19.94 | 30669 |
| 628 | ATTTACACTTAATTATACTT | 4-1-2-6-2-3-2 | ATTTaCActtaatTAtacTT | 628_6 | -21.29 | 30669 |
| 628 | ATTTACACTTAATTATACTT | 1-1-4-7-1-1-1-2-2 | AtTTACacttaatTaTacTT | 628_7 | -19.33 | 30669 |
| 628 | ATTTACACTTAATTATACTT | 2-2-3-6-1-2-4 | ATttACActtaatTatACTT | 628_8 | -20.97 | 30669 |
| 628 | ATTTACACTTAATTATACTT | 4-2-1-6-1-3-3 | ATTTacActtaatTataCTT | 628_9 | -19.73 | 30669 |
| 628 | ATTTACACTTAATTATACTT | 1-1-2-1-2-6-4-1-2 | AtTTaCActtaatTATAcTT | 628_10 | -22.43 | 30669 |
| 628 | ATTTACACTTAATTATACTT | 3-2-2-6-2-2-3 | ATTtaCActtaatTATaCTT | 628_11 | -21.72 | 30669 |
| 628 | ATTTACACTTAATTATACTT | 1-2-4-6-2-2-3 | AttTACActtaatTAtaCTT | 628_12 | -22.02 | 30669 |
| 628 | ATTTACACTTAATTATACTT | 2-1-1-1-2-6-1-1-5 | ATtTaCActtaatTaTACTT | 628_13 | -23.00 | 30669 |
| 628 | ATTTACACTTAATTATACTT | 5-8-1-1-1-3 | ATTTAcacttaatTaTaCTT | 628_14 | -21.68 | 30669 |
| 629 | TTCTACTATACTTTCCTCT | 1-3-1-7-1-1-1-2-2 | TtctActatactTtCctCT | 629_1 | -21.04 | 30711 |
| 629 | TTCTACTATACTTTCCTCT | 1-11-1-1-1-2-2 | Ttctactatact TtCctCT | 629_2 | -20.85 | 30711 |
| 629 | TTCTACTATACTTTCCTCT | 1-11-1-2-1-1-2 | Ttctactatact TtcCtCT | 629_3 | -20.97 | 30711 |
| 629 | TTCTACTATACTTTCCTCT | 1-1-1-9-1-4-2 | TtCtactatactTtcctCT | 629_4 | -21.06 | 30711 |
| 629 | TTCTACTATACTTTCCTCT | 1-1-1-11-1-2-2 | TtCtactatactttCctCT | 629_5 | -21.53 | 30711 |
| 629 | TTCTACTATACTTTCCTCT | 1-3-1-9-1-2-2 | TtctActatactttCctCT | 629_6 | -20.74 | 30711 |
| 629 | TTCTACTATACTTTCCTCT | 1-4-1-8-1-2-2 | TtctaCtatactttCctCT | 629_7 | -21.54 | 30711 |
| 629 | TTCTACTATACTTTCCTCT | 1-13-1-2-2 | TtctactatactttCctCT | 629_8 | -20.55 | 30711 |
| 629 | TTCTACTATACTTTCCTCT | 1-1-1-12-1-1-2 | TtCtactatactttcCtCT | 629_9 | -21.65 | 30711 |
| 629 | TTCTACTATACTTTCCTCT | 1-3-1-10-1-1-2 | TtctActatactttcCtCT | 629_10 | -20.86 | 30711 |
| 629 | TTCTACTATACTTTCCTCT | 1-14-1-1-2 | TtctactatactttcCtCT | 629_11 | -20.67 | 30711 |
| 629 | TTCTACTATACTTTCCTCT | 1-1-1-1-1-7-1-1-2-2 | TtCtActatactTtCctCT | 629_12 | -22.02 | 30711 |
| 629 | TTCTACTATACTTTCCTCT | 1-1-2-1-8-1-2-2 | TtCtaCtatactttCctCT | 629_13 | -22.52 | 30711 |
| 629 | TTCTACTATACTTTCCTCT | 1-3-2-8-1-2-2 | TtctACtatactttCctCT | 629_14 | -22.14 | 30711 |
| 629 | TTCTACTATACTTTCCTCT | 1-1-1-1-10-1-1-2 | TtCtActatactttcCtCT | 629_15 | -21.84 | 30711 |
| 629 | TTCTACTATACTTTCCTCT | 1-1-1-2-1-9-1-1-2 | TtCtaCtatactttcCtCT | 629_16 | -22.64 | 30711 |
| 630 | GTTCTACTATACTTTCCTC | 1-12-1-1-1-1-2 | GttctactatactTtCcTC | 630_1 | -20.78 | 30712 |
| 630 | GTTCTACTATACTTTCCTC | 1-4-1-9-1-1-2 | GttctActatactttCcTC | 630_2 | -20.67 | 30712 |
| 630 | GTTCTACTATACTTTCCTC | 1-14-1-1-2 | GttctactatactttCcTC | 630_3 | -20.48 | 30712 |
| 631 | GTTCTACTATACTTTCCT | 1-2-1-1-1-7-1-2-2 | GttCtActatactTtcCT | 631_1 | -20.25 | 30713 |
| 631 | GTTCTACTATACTTTCCT | 1-2-1-9-1-2-2 | GttCtactatactTtcCT | 631_2 | -20.06 | 30713 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 631 | GTTCTACTATACTTTCCT | 1-2-1-11-3 | GttCtactatactttCCT | 631_3 | -22.13 | 30713 |
| 631 | GTTCTACTATACTTTCCT | 1-4-1-9-3 | GttctActatactttCCT | 631_4 | -21.34 | 30713 |
| 631 | GTTCTACTATACTTTCCT | 1-14-3 | GttctactatactttCCT | 631_5 | -21.15 | 30713 |
| 631 | GTTCTACTATACTTTCCT | 2-1-1-1-1-10-2 | GTtCtActatactttcCT | 631_6 | -21.50 | 30713 |
| 631 | GTTCTACTATACTTTCCT | 2-1-1-12-2 | GTtCtactatactttcCT | 631_7 | -21.30 | 30713 |
| 631 | GTTCTACTATACTTTCCT | 1-2-1-1-1-10-2 | GttCtActatactttcCT | 631_8 | -19.95 | 30713 |
| 631 | GTTCTACTATACTTTCCT | 1-2-1-12-2 | GttCtactatactttcCT | 631_9 | -19.76 | 30713 |
| 631 | GTTCTACTATACTTTCCT | 1-15-2 | GttctactatactttcCT | 631_10 | -18.78 | 30713 |
| 631 | GTTCTACTATACTTTCCT | 1-2-1-9-1-1-3 | GttCtactatactTtCCT | 631_11 | -22.43 | 30713 |
| 631 | GTTCTACTATACTTTCCT | 2-1-1-1-1-7-1-2-2 | GTtCtActatactTtcCT | 631_12 | -21.80 | 30713 |
| 631 | GTTCTACTATACTTTCCT | 1-2-2-8-1-2-2 | GttCTactatactTtcCT | 631_13 | -21.68 | 30713 |
| 631 | GTTCTACTATACTTTCCT | 1-2-1-1-1-9-3 | GttCtActatactttCCT | 631_14 | -22.32 | 30713 |
| 631 | GTTCTACTATACTTTCCT | 1-2-3-10-2 | GttCTActatactttcCT | 631_15 | -22.60 | 30713 |
| 632 | AGTTCTACTATACTTTCC | 1-12-1-2-2 | AgttctactatacTttCC | 632_1 | -19.37 | 30714 |
| 632 | AGTTCTACTATACTTTCC | 1-13-1-1-2 | AgttctactatactTtCC | 632_2 | -19.16 | 30714 |
| 632 | AGTTCTACTATACTTTCC | 1-1-1-13-2 | AgTtctactatactttCC | 632_3 | -19.51 | 30714 |
| 632 | AGTTCTACTATACTTTCC | 1-15-2 | AgttctactatactttCC | 632_4 | -18.86 | 30714 |
| 632 | AGTTCTACTATACTTTCC | 1-1-1-10-1-2-2 | AgTtctactatacTttCC | 632_5 | -20.03 | 30714 |
| 632 | AGTTCTACTATACTTTCC | 1-4-1-7-1-2-2 | AgttcTactatacTttCC | 632_6 | -20.31 | 30714 |
| 632 | AGTTCTACTATACTTTCC | 2-14-2 | AGttctactatactttCC | 632_7 | -20.26 | 30714 |
| 632 | AGTTCTACTATACTTTCC | 1-2-1-12-2 | AgtTctactatactttCC | 632_8 | -19.23 | 30714 |
| 632 | AGTTCTACTATACTTTCC | 1-4-1-10-2 | AgttcTactatactttCC | 632_9 | -19.80 | 30714 |
| 632 | AGTTCTACTATACTTTCC | 2-10-1-3-2 | AGttctactataCtttCC | 632_10 | -21.25 | 30714 |
| 632 | AGTTCTACTATACTTTCC | 1-4-1-6-1-3-2 | AgttcTactataCtttCC | 632_11 | -20.79 | 30714 |
| 632 | AGTTCTACTATACTTTCC | 1-4-1-7-2-1-2 | AgttcTactatacTTtCC | 632_12 | -21.13 | 30714 |
| 632 | AGTTCTACTATACTTTCC | 1-1-1-11-1-1-2 | AgTtctactatactTtCC | 632_13 | -19.82 | 30714 |
| 632 | AGTTCTACTATACTTTCC | 1-3-1-11-2 | AgttCtactatactttCC | 632_14 | -19.83 | 30714 |
| 633 | CAACATTATTAACCACCTTA | 1-13-3-1-2 | CaacattattaaccACCtTA | 633_1 | -22.44 | 33376 |
| 633 | CAACATTATTAACCACCTTA | 4-10-1-2-3 | CAACattattaaccAccTTA | 633_2 | -22.98 | 33376 |
| 633 | CAACATTATTAACCACCTTA | 2-2-1-10-1-1-3 | CAacAttattaaccaCcTTA | 633_3 | -21.97 | 33376 |
| 633 | CAACATTATTAACCACCTTA | 1-4-2-8-1-2-2 | CaacaTTattaaccaCctTA | 633_4 | -21.08 | 33376 |
| 633 | CAACATTATTAACCACCTTA | 1-1-2-11-1-2-2 | CaACattattaaccaCctTA | 633_5 | -20.90 | 33376 |
| 633 | CAACATTATTAACCACCTTA | 1-2-2-13-2 | CaaCAttattaaccacctTA | 633_6 | -20.76 | 33376 |
| 633 | CAACATTATTAACCACCTTA | 1-1-1-1-1-11-1-1-2 | CaAcAttattaaccaCtTA | 633_7 | -19.97 | 33376 |
| 633 | CAACATTATTAACCACCTTA | 1-15-4 | CaacattattaaccacCTTA | 633_8 | -21.21 | 33376 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 633 | CAACATTATTAACCACCTTA | 2-4-1-11-2 | CAacatTattaaccacctTA | 633_9 | −20.83 | 33376 |
| 634 | CAACATTATTAACCACCTT | 2-10-2-3-2 | CAacattattaaCCaccTT | 634_1 | −21.86 | 33377 |
| 634 | CAACATTATTAACCACCTT | 1-14-4 | CaacattattaaccaCCTT | 634_2 | −21.36 | 33377 |
| 634 | CAACATTATTAACCACCTT | 1-1-1-11-1-1-3 | CaAcattattaaccAcCTT | 634_3 | −19.54 | 33377 |
| 634 | CAACATTATTAACCACCTT | 3-1-1-11-3 | CAAcAttattaaccacCTT | 634_4 | −21.13 | 33377 |
| 634 | CAACATTATTAACCACCTT | 3-11-2-1-2 | CAAcattattaaccACcTT | 634_5 | −20.84 | 33377 |
| 634 | CAACATTATTAACCACCTT | 2-1-2-9-1-1-3 | CAaCattattaaccAcCTT | 634_6 | −22.76 | 33377 |
| 634 | CAACATTATTAACCACCTT | 2-1-2-10-1-1-2 | CAaCattattaaccaCcTT | 634_7 | −21.83 | 33377 |
| 634 | CAACATTATTAACCACCTT | 1-1-2-11-1-1-2 | CaACattattaaccaCcTT | 634_8 | −19.70 | 33377 |
| 634 | CAACATTATTAACCACCTT | 1-2-1-12-3 | CaaCattattaaccacCTT | 634_9 | −19.66 | 33377 |
| 635 | GCAACATTATTAACCACCT | 1-1-1-2-1-6-2-3-2 | GcAacAttattaACcacCT | 635_1 | −21.56 | 33378 |
| 635 | GCAACATTATTAACCACCT | 1-1-2-1-1-6-1-2-1-2 | GcAAcAttattaAccAcCT | 635_2 | −21.14 | 33378 |
| 635 | GCAACATTATTAACCACCT | 1-11-2-1-1-1-2 | GcaacattattaACcAcCT | 635_3 | −21.59 | 33378 |
| 635 | GCAACATTATTAACCACCT | 1-4-1-6-1-3-3 | GcaacAttattaAccaCCT | 635_4 | −22.69 | 33378 |
| 635 | GCAACATTATTAACCACCT | 1-1-1-1-1-7-1-4-2 | GcAaCattattaAccacCT | 635_5 | −21.01 | 33378 |
| 635 | GCAACATTATTAACCACCT | 1-11-1-1-1-2-2 | GcaacattattaAcCacCT | 635_6 | −20.83 | 33378 |
| 635 | GCAACATTATTAACCACCT | 2-3-1-6-1-4-2 | GCaacAttattaAccacCT | 635_7 | −22.63 | 33378 |
| 635 | GCAACATTATTAACCACCT | 1-1-1-12-1-1-2 | GcAacattattaaccAcCT | 635_8 | −20.05 | 33378 |
| 635 | GCAACATTATTAACCACCT | 1-2-1-1-1-11-2 | GcaAcAttattaaccacCT | 635_9 | −20.30 | 33378 |
| 636 | AGCAACATTATTAACCACC | 1-2-1-9-2-1-3 | AgcAacattattaACcACC | 636_1 | −22.13 | 33379 |
| 636 | AGCAACATTATTAACCACC | 1-11-1-1-1-2-2 | AgcaacattattAaCcaCC | 636_2 | −20.80 | 33379 |
| 636 | AGCAACATTATTAACCACC | 1-4-1-6-2-3-2 | AgcaaCattattAAccaCC | 636_3 | −21.32 | 33379 |
| 636 | AGCAACATTATTAACCACC | 1-2-2-7-1-2-1-1-2 | AgcAAcattattAacCaCC | 636_4 | −21.29 | 33379 |
| 636 | AGCAACATTATTAACCACC | 2-11-1-3-2 | AGcaacattattaAccaCC | 636_5 | −21.75 | 33379 |
| 636 | AGCAACATTATTAACCACC | 1-1-1-1-1-8-1-2-3 | AgCaAcattattaAccACC | 636_6 | −22.16 | 33379 |
| 636 | AGCAACATTATTAACCACC | 1-2-1-1-1-6-1-3-3 | AgcAaCattattAaccACC | 636_7 | −21.33 | 33379 |
| 636 | AGCAACATTATTAACCACC | 2-1-2-12-2 | AGcAAcattattaaccaCC | 636_8 | −22.02 | 33379 |
| 636 | AGCAACATTATTAACCACC | 1-15-3 | AgcaacattattaaccACC | 636_9 | −20.45 | 33379 |
| 637 | AGCAACATTATTAACCAC | 2-1-1-9-5 | AGcAacattattaACCAC | 637_1 | −21.97 | 33380 |
| 637 | AGCAACATTATTAACCAC | 1-3-1-7-6 | AgcaAcattattAACCAC | 637_2 | −21.20 | 33380 |
| 637 | AGCAACATTATTAACCAC | 2-10-2-1-3 | AGcaacattattAAcCAC | 637_3 | −19.42 | 33380 |
| 637 | AGCAACATTATTAACCAC | 1-2-1-8-1-1-4 | AgcAacattattAaCCAC | 637_4 | −19.84 | 33380 |
| 637 | AGCAACATTATTAACCAC | 3-9-3-1-2 | AGCaacattattAACcAC | 637_5 | −20.94 | 33380 |
| 637 | AGCAACATTATTAACCAC | 1-1-3-7-3-1-2 | AgCAAcattattAACcAC | 637_6 | −20.15 | 33380 |
| 637 | AGCAACATTATTAACCAC | 1-1-3-7-2-1-3 | AgCAAcattattAAcCAC | 637_7 | −20.96 | 33380 |
| 637 | AGCAACATTATTAACCAC | 5-7-1-3-2 | AGCAAcattattAaccAC | 637_8 | −21.24 | 33380 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 637 | AGCAACATTATTAACCAC | 3-1-1-8-1-2-2 | AGCaAcattattaAccAC | 637_9 | -19.86 | 33380 |
| 638 | GTTTCCATCTACTATTAAT | 1-3-1-7-1-1-1-3 | GtttCcatctacTaTtAAT | 638_1 | -19.59 | 39806 |
| 638 | GTTTCCATCTACTATTAAT | 1-1-1-9-2-3-2 | GtTtccatctacTAttaAT | 638_2 | -19.50 | 39806 |
| 638 | GTTTCCATCTACTATTAAT | 1-4-1-6-2-2-3 | GtttcCatctacTAttAAT | 638_3 | -20.09 | 39806 |
| 638 | GTTTCCATCTACTATTAAT | 1-3-1-8-1-2-3 | GtttCcatctactAttAAT | 638_4 | -18.30 | 39806 |
| 638 | GTTTCCATCTACTATTAAT | 3-1-1-8-1-3-2 | GTTtCcatctactattaAT | 638_5 | -20.35 | 39806 |
| 638 | GTTTCCATCTACTATTAAT | 1-2-2-12-2 | GttTCcatctactattaAT | 638_6 | -18.88 | 39806 |
| 638 | GTTTCCATCTACTATTAAT | 1-1-1-11-1-1-3 | GtTccatctactaTtAAT | 638_7 | -18.18 | 39806 |
| 638 | GTTTCCATCTACTATTAAT | 2-2-1-10-1-1-2 | GTttCcatctactatTaAT | 638_8 | -20.16 | 39806 |
| 638 | GTTTCCATCTACTATTAAT | 1-1-1-1-2-10-3 | GtTcCatctactattAAT | 638_9 | -20.69 | 39806 |
| 638 | GTTTCCATCTACTATTAAT | 2-2-1-7-1-3-3 | GTttCcatctacTattAAT | 638_10 | -20.69 | 39806 |
| 638 | GTTTCCATCTACTATTAAT | 1-1-1-10-2-1-3 | GtTccatctactATTAAT | 638_11 | -19.08 | 39806 |
| 638 | GTTTCCATCTACTATTAAT | 1-3-1-8-1-1-1-2 | GtttCcatctactAtTaAT | 638_12 | -18.72 | 39806 |
| 638 | GTTTCCATCTACTATTAAT | 1-2-3-7-1-2-3 | GttTCCatctactAttAAT | 638_13 | -21.47 | 39806 |
| 638 | GTTTCCATCTACTATTAAT | 1-1-1-1-2-11-2 | GtTcCatctactattaAT | 638_14 | -20.37 | 39806 |
| 639 | GTTTCCATCTACTATTAA | 1-11-2-1-3 | GtttccatctacTAtTAA | 639_1 | -19.21 | 39807 |
| 639 | GTTTCCATCTACTATTAA | 1-3-1-7-1-1-4 | GtttCcatctacTaTTAA | 639_2 | -19.80 | 39807 |
| 639 | GTTTCCATCTACTATTAA | 3-1-1-7-2-2-2 | GTTtCcatctacTAttAA | 639_3 | -20.57 | 39807 |
| 639 | GTTTCCATCTACTATTAA | 2-2-1-7-1-1-1-2 | GTttCcatctacTaTtAA | 639_4 | -19.07 | 39807 |
| 639 | GTTTCCATCTACTATTAA | 1-3-2-7-2-1-2 | GtttCCatctactATTAA | 639_5 | -19.67 | 39807 |
| 639 | GTTTCCATCTACTATTAA | 3-2-1-6-1-3-2 | GTTtcCatctacTattAA | 639_6 | -19.25 | 39807 |
| 639 | GTTTCCATCTACTATTAA | 1-1-3-8-1-2-2 | GtTTCcatctactAttAA | 639_7 | -18.04 | 39807 |
| 639 | GTTTCCATCTACTATTAA | 1-1-1-1-2-10-2 | GtTcCatctactattAA | 639_8 | -18.62 | 39807 |
| 639 | GTTTCCATCTACTATTAA | 3-1-1-9-4 | GTTtCcatctactaTTAA | 639_9 | -21.21 | 39807 |
| 639 | GTTTCCATCTACTATTAA | 1-3-2-6-2-2-2 | GtttCCatctacTAttAA | 639_10 | -20.39 | 39807 |
| 639 | GTTTCCATCTACTATTAA | 1-1-3-7-1-1-1-2 | GtTTCcatctacTaTtAA | 639_11 | -19.32 | 39807 |
| 639 | GTTTCCATCTACTATTAA | 2-2-1-7-1-2-3 | GTttCcatctacTatTAA | 639_12 | -20.39 | 39807 |
| 639 | GTTTCCATCTACTATTAA | 2-2-1-8-2-1-2 | GTttCcatctactATTAA | 639_13 | -19.03 | 39807 |
| 639 | GTTTCCATCTACTATTAA | 1-1-1-1-2-8-4 | GtTcCatctactaTTAA | 639_14 | -21.34 | 39807 |
| 640 | TGTTTCCATCTACTATTA | 1-1-1-11-1-1-2 | TgTttccatctactAtTA | 640_1 | -18.41 | 39808 |
| 640 | TGTTTCCATCTACTATTA | 1-2-1-9-2-1-2 | TgtTtccatctacTAtTA | 640_2 | -20.03 | 39808 |
| 640 | TGTTTCCATCTACTATTA | 1-4-1-7-1-2-2 | TgtttCcatctacTatTA | 640_3 | -19.37 | 39808 |
| 640 | TGTTTCCATCTACTATTA | 1-4-1-8-4 | TgtttCcatctactATTA | 640_4 | -20.28 | 39808 |
| 640 | TGTTTCCATCTACTATTA | 1-4-1-8-1-1-2 | TgtttCcatctactAtTA | 640_5 | -18.52 | 39808 |
| 640 | TGTTTCCATCTACTATTA | 1-1-2-1-1-10-2 | TgTTtCcatctactatTA | 640_6 | -19.89 | 39808 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 640 | TGTTTCCATCTACTATTA | 1-4-1-9-3 | TgtttCcatctactaTTA | 640_7 | -19.37 | 39808 |
| 640 | TGTTTCCATCTACTATTA | 1-2-1-1-1-10-2 | TgtTtCcatctactatTA | 640_8 | -18.73 | 39808 |
| 640 | TGTTTCCATCTACTATTA | 1-4-1-10-2 | TgtttCcatctactatTA | 640_9 | -18.42 | 39808 |
| 640 | TGTTTCCATCTACTATTA | 1-4-1-6-1-1-4 | TgtttCcatctaCtATTA | 640_10 | -21.27 | 39808 |
| 640 | TGTTTCCATCTACTATTA | 2-1-1-9-2-1-2 | TGtTtccatctacTAtTA | 640_11 | -21.24 | 39808 |
| 640 | TGTTTCCATCTACTATTA | 1-3-2-8-1-1-2 | TgtttCcatctactAtTA | 640_12 | -19.51 | 39808 |
| 640 | TGTTTCCATCTACTATTA | 2-1-1-1-1-10-2 | TGtTtCcatctactatTA | 640_13 | -19.94 | 39808 |
| 640 | TGTTTCCATCTACTATTA | 1-1-1-2-1-10-2 | TgTttCcatctactatTA | 640_14 | -19.08 | 39808 |
| 641 | ACTCTGCAATACACCAA | 2-1-1-8-2-1-2 | ACtCtgcaatacACcAA | 641_1 | -19.61 | 44439 |
| 641 | ACTCTGCAATACACCAA | 2-2-1-6-1-1-1-2 | ACtcTgcaataCaCcAA | 641_2 | -19.77 | 44439 |
| 641 | ACTCTGCAATACACCAA | 1-2-1-7-1-1-1-2 | ActCtgcaataCaCcAA | 641_3 | -18.35 | 44439 |
| 641 | ACTCTGCAATACACCAA | 2-1-2-6-2-2-2 | ACtCTgcaataCAccAA | 641_4 | -22.21 | 44439 |
| 641 | ACTCTGCAATACACCAA | 1-3-1-7-1-1-3 | ActcTgcaatacAcCAA | 641_5 | -19.05 | 44439 |
| 641 | ACTCTGCAATACACCAA | 4-8-1-2-2 | ACTCtgcaatacAccAA | 641_6 | -20.30 | 44439 |
| 641 | ACTCTGCAATACACCAA | 2-1-2-9-3 | ACtCTgcaatacacCAA | 641_7 | -21.96 | 44439 |
| 641 | ACTCTGCAATACACCAA | 2-11-4 | ACtctgcaatacaCCAA | 641_8 | -21.68 | 44439 |
| 641 | ACTCTGCAATACACCAA | 1-1-2-10-3 | AcTCtgcaatacacCAA | 641_9 | -20.07 | 44439 |
| 642 | CTGTATACACCATCCCA | 1-10-1-1-1-2 | CtgtatacaccAtCcCA | 642_1 | -21.99 | 46391 |
| 642 | CTGTATACACCATCCCA | 1-10-1-3-2 | CtgtatacaccAtccCA | 642_2 | -21.22 | 46391 |
| 642 | CTGTATACACCATCCCA | 1-1-1-8-1-3-2 | CtGtatacaccAtccCA | 642_3 | -21.53 | 46391 |
| 642 | CTGTATACACCATCCCA | 1-2-1-7-1-3-2 | CtgTatacaccAtccCA | 642_4 | -22.31 | 46391 |
| 642 | CTGTATACACCATCCCA | 1-3-1-6-1-3-2 | CtgtAtacaccAtccCA | 642_5 | -21.32 | 46391 |
| 642 | CTGTATACACCATCCCA | 1-11-2-1-2 | CtgtatacaccaTCcCA | 642_6 | -23.06 | 46391 |
| 642 | CTGTATACACCATCCCA | 1-1-1-1-8-1-1-2 | CtGtAtacaccatCcCA | 642_7 | -22.35 | 46391 |
| 642 | CTGTATACACCATCCCA | 1-1-1-10-1-1-2 | CtGtatacaccatCcCA | 642_8 | -22.25 | 46391 |
| 642 | CTGTATACACCATCCCA | 1-2-1-9-1-1-2 | CtgTatacaccatCcCA | 642_9 | -23.02 | 46391 |
| 642 | CTGTATACACCATCCCA | 1-3-1-8-1-1-2 | CtgtAtacaccatCcCA | 642_10 | -22.04 | 46391 |
| 642 | CTGTATACACCATCCCA | 1-12-1-1-2 | CtgtatacaccatCcCA | 642_11 | -21.94 | 46391 |
| 642 | CTGTATACACCATCCCA | 2-2-1-10-2 | CTgtAtacaccatccCA | 642_12 | -22.95 | 46391 |
| 642 | CTGTATACACCATCCCA | 1-1-1-1-1-10-2 | CtGtAtacaccatccCA | 642_13 | -21.58 | 46391 |
| 642 | CTGTATACACCATCCCA | 1-1-1-12-2 | CtGtatacaccatccCA | 642_14 | -21.48 | 46391 |
| 642 | CTGTATACACCATCCCA | 1-2-2-10-2 | CtgTAtacaccatccCA | 642_15 | -23.39 | 46391 |
| 642 | CTGTATACACCATCCCA | 1-3-1-10-2 | CtgtAtacaccatccCA | 642_16 | -21.27 | 46391 |
| 642 | CTGTATACACCATCCCA | 1-14-2 | CtgtatacaccatccCA | 642_17 | -21.17 | 46391 |
| 642 | CTGTATACACCATCCCA | 1-3-1-6-3-1-2 | CtgtAtacaccATCcCA | 642_18 | -24.02 | 46391 |
| 642 | CTGTATACACCATCCCA | 1-1-1-8-1-1-1-2 | CtGtatacaccAtCcCA | 642_19 | -22.30 | 46391 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 642 | CTGTATACACCATCCCA | 1-1-3-6-1-3-2 | CtGTAtacaccAtccCA | 642_20 | −24.64 | 46391 |
| 642 | CTGTATACACCATCCCA | 2-2-1-8-1-1-2 | CTgtAtacaccatCcCA | 642_21 | −23.72 | 46391 |
| 642 | CTGTATACACCATCCCA | 1-3-1-9-3 | CtgtAtacaccatcCCA | 642_22 | −23.55 | 46391 |
| 643 | TCTGTATACACCATCCCA | 1-4-1-8-1-1-2 | TctgtAtacaccatCcCA | 643_1 | −22.94 | 46391 |
| 644 | TCTGTATACACCATCCC | 2-10-1-2-2 | TCtgtatacaccAtcCC | 644_1 | −22.70 | 46392 |
| 644 | TCTGTATACACCATCCC | 1-11-1-2-2 | TctgtatacaccAtcCC | 644_2 | −21.11 | 46392 |
| 644 | TCTGTATACACCATCCC | 2-1-1-11-2 | TCtGtatacaccatcCC | 644_3 | −22.96 | 46392 |
| 644 | TCTGTATACACCATCCC | 2-13-2 | TCtgtatacaccatCC | 644_4 | −22.65 | 46392 |
| 644 | TCTGTATACACCATCCC | 3-9-1-2-2 | TCTgtatacaccAtcCC | 644_5 | −24.39 | 46392 |
| 644 | TCTGTATACACCATCCC | 2-1-1-8-1-2-2 | TCtGtatacaccAtcCC | 644_6 | −23.01 | 46392 |
| 645 | TTCTGTATACACCATCCC | 1-11-1-3-2 | TtctgtatacacCatcCC | 645_1 | −22.57 | 46392 |
| 645 | TTCTGTATACACCATCCC | 1-1-1-10-1-2-2 | TtCtgtatacaccAtcCC | 645_2 | −23.02 | 46392 |
| 645 | TTCTGTATACACCATCCC | 1-3-1-8-1-2-2 | TtctGtatacaccAtcCC | 645_3 | −22.36 | 46392 |
| 645 | TTCTGTATACACCATCCC | 1-12-1-2-2 | TtctgtatacaccAtcCC | 645_4 | −22.05 | 46392 |
| 645 | TTCTGTATACACCATCCC | 1-15-2 | TtctgtatacaccatcCC | 645_5 | −22.00 | 46392 |
| 645 | TTCTGTATACACCATCCC | 1-4-1-6-2-2-2 | TtctgTatacacCAtcCC | 645_6 | −25.12 | 46392 |
| 645 | TTCTGTATACACCATCCC | 1-3-1-8-1-1-3 | TtctGtatacaccAtCCC | 645_7 | −24.73 | 46392 |
| 645 | TTCTGTATACACCATCCC | 3-10-1-2-2 | TTCtgtatacaccAtcCC | 645_8 | −24.52 | 46392 |
| 645 | TTCTGTATACACCATCCC | 1-1-2-9-1-2-2 | TtCTgtatacaccAtcCC | 645_9 | −24.71 | 46392 |
| 645 | TTCTGTATACACCATCCC | 1-1-1-1-1-8-1-2-2 | TtCtGtatacaccAtcCC | 645_10 | −23.34 | 46392 |
| 646 | TTCTGTATACACCATCC | 1-10-1-3-2 | TtctgtatacaCcatCC | 646_1 | −19.96 | 46393 |
| 646 | TTCTGTATACACCATCC | 1-12-4 | TtctgtatacaccATCC | 646_2 | −21.16 | 46393 |
| 646 | TTCTGTATACACCATCC | 2-11-1-1-2 | TTctgtatacaccAtCC | 646_3 | −20.11 | 46393 |
| 646 | TTCTGTATACACCATCC | 1-2-1-9-1-1-2 | TtcTgtatacaccAtCC | 646_4 | −20.24 | 46393 |
| 646 | TTCTGTATACACCATCC | 1-3-1-8-1-1-2 | TtctGtatacaccAtCC | 646_5 | −19.54 | 46393 |
| 646 | TTCTGTATACACCATCC | 1-2-1-8-1-2-2 | TtcTgtatacacCatCC | 646_6 | −20.77 | 46393 |
| 646 | TTCTGTATACACCATCC | 1-12-1-1-2 | TtctgtatacaccAtCC | 646_7 | −19.23 | 46393 |
| 646 | TTCTGTATACACCATCC | 1-3-1-7-1-1-3 | TtctGtatacacCaTCC | 646_8 | −21.19 | 46393 |
| 646 | TTCTGTATACACCATCC | 1-1-1-1-1-10-2 | TtCtGtatacaccatCC | 646_9 | −20.47 | 46393 |
| 646 | TTCTGTATACACCATCC | 1-1-1-12-2 | TtCtgtatacaccatCC | 646_10 | −20.16 | 46393 |
| 646 | TTCTGTATACACCATCC | 1-1-1-11-3 | TtCtgtatacaccaTCC | 646_11 | −21.28 | 46393 |
| 646 | TTCTGTATACACCATCC | 1-3-1-9-3 | TtctGtatacaccaTCC | 646_12 | −20.61 | 46393 |
| 646 | TTCTGTATACACCATCC | 1-13-3 | TtctgtatacaccaTCC | 646_13 | −20.30 | 46393 |
| 646 | TTCTGTATACACCATCC | 3-1-1-10-2 | TTCtGtatacaccatCC | 646_14 | −21.96 | 46393 |
| 646 | TTCTGTATACACCATCC | 3-12-2 | TTCtgtatacaccatCC | 646_15 | −21.65 | 46393 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 646 | TTCTGTATACACCATCC | 1-1-2-11-2 | TtCTgtatacaccatCC | 646_16 | -21.84 | 46393 |
| 646 | TTCTGTATACACCATCC | 1-2-1-11-2 | TtcTgtatacaccatCC | 646_17 | -20.19 | 46393 |
| 646 | TTCTGTATACACCATCC | 1-3-1-10-2 | TtctGtatacaccatCC | 646_18 | -19.49 | 46393 |
| 646 | TTCTGTATACACCATCC | 1-14-2 | Ttctgtatacaccatcc | 646_19 | -19.18 | 46393 |
| 646 | TTCTGTATACACCATCC | 3-8-1-3-2 | TTCtgtatacaCcatCC | 646_20 | -22.44 | 46393 |
| 646 | TTCTGTATACACCATCC | 1-3-1-6-1-3-2 | TtctGtatacaCcatCC | 646_21 | -20.27 | 46393 |
| 646 | TTCTGTATACACCATCC | 1-3-1-7-2-1-2 | TtctGtatacacCAtCC | 646_22 | -21.53 | 46393 |
| 646 | TTCTGTATACACCATCC | 1-1-1-9-1-2-2 | TtCtgtatacacCatCC | 646_23 | -20.74 | 46393 |
| 646 | TTCTGTATACACCATCC | 1-1-1-10-1-1-2 | TtCtgtatacaccAtCC | 646_24 | -20.21 | 46393 |
| 647 | AGCTTTTAACCAGAGT | 2-10-4 | AGcttttaaccaGAGT | 647_1 | -21.73 | EX-EX |
| 648 | AGCTTTTAACCAGAGTG | 2-11-4 | AGcttttaaccagAGTG | 648_1 | -22.27 | EX-EX |
| 649 | AGCTTTTAACCAGAGTGG | 1-14-3 | AgcttttaaccagagTGG | 649_1 | -21.63 | EX-EX |
| 650 | AGCTTTTAACCAGAGTGGC | 1-16-2 | AgcttttaaccagagtgGC | 650_1 | -23.20 | EX-EX |
| 651 | AGCTTTTAACCAGAGTGGCA | 1-17-2 | AgcttttaaccagagtggCA | 651_1 | -24.11 | EX-EX |
| 652 | CAGCTTTTAACCAGAGT | 2-12-3 | CAgcttttaaccagAGT | 652_1 | -21.65 | EX-EX |
| 653 | CAGCTTTTAACCAGAGTG | 3-13-2 | CAGcttttaaccagagTG | 653_1 | -22.27 | EX-EX |
| 654 | CAGCTTTTAACCAGAGTGG | 1-15-3 | CagcttttaaccagagTGG | 654_1 | -22.97 | EX-EX |
| 655 | CAGCTTTTAACCAGAGTGGC | 1-17-2 | CagcttttaaccagagtgGC | 655_1 | -24.53 | EX-EX |
| 656 | CTTTTAACCAGAGTG | 4-7-4 | CTTTtaaccagAGTG | 656_1 | -20.12 | EX-EX |
| 657 | CTTTTAACCAGAGTGG | 4-9-3 | CTTTtaaccagagTGG | 657_1 | -20.92 | EX-EX |
| 658 | CTTTTAACCAGAGTGGC | 4-11-2 | CTTTtaaccagagtgGC | 658_1 | -22.48 | EX-EX |
| 659 | CTTTTAACCAGAGTGGCA | 1-14-3 | CttttaaccagagtgGCA | 659_1 | -22.96 | EX-EX |
| 660 | CTTTTAACCAGAGTGGCAT | 3-13-3 | CTTttaaccagagtggCAT | 660_1 | -24.65 | EX-EX |
| 661 | CTTTTAACCAGAGTGGCATC | 2-16-2 | CTttttaaccagagtggcaTC | 661_1 | -23.19 | EX-EX |
| 662 | GCTTTTAACCAGAGT | 3-9-3 | GCTtttaaccagAGT | 662_1 | -21.02 | EX-EX |
| 663 | GCTTTTAACCAGAGTG | 4-10-2 | GCTTttaaccagagTG | 663_1 | -21.02 | EX-EX |
| 664 | GCTTTTAACCAGAGTGG | 1-12-4 | GcttttaaccagaGTGG | 664_1 | -22.24 | EX-EX |
| 665 | GCTTTTAACCAGAGTGGC | 1-14-3 | GcttttaaccagagtGGC | 665_1 | -23.42 | EX-EX |
| 666 | GCTTTTAACCAGAGTGGCA | 1-16-2 | GcttttaaccagagtggCA | 666_1 | -22.94 | EX-EX |
| 667 | GCTTTTAACCAGAGTGGCAT | 1-16-3 | GcttttaaccagagtggCAT | 667_1 | -25.01 | EX-EX |
| 668 | TCAGCTTTTAACCAGAGT | 2-13-3 | TCagcttttaaccagAGT | 668_1 | -22.18 | EX-EX |
| 669 | TCAGCTTTTAACCAGAGTG | 2-14-3 | TCagcttttaaccagaGTG | 669_1 | -23.15 | EX-EX |
| 670 | TCAGCTTTTAACCAGAGTGG | 2-16-2 | TCagcttttaaccagagtGG | 670_1 | -23.41 | EX-EX |
| 671 | TTCAGCTTTTAACCAGAGT | 2-14-3 | TTcagcttttaaccagAGT | 671_1 | -22.72 | EX-EX |
| 672 | TTCAGCTTTTAACCAGAGTG | 2-15-3 | TTcagcttttaaccagaGTG | 672_1 | -23.69 | EX-EX |
| 673 | TTTCAGCTTTTAACCAGAGT | 2-15-3 | TTtcagcttttaaccagAGT | 673_1 | -23.66 | EX-EX |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 674 | TTTTAACCAGAGTGGC | 1-11-4 | TtttaaccagagTGGC | 674_1 | -20.81 | EX-EX |
| 675 | TTTTAACCAGAGTGGCA | 3-11-3 | TTTtaaccagagtgGCA | 675_1 | -22.30 | EX-EX |
| 676 | TTTTAACCAGAGTGGCAT | 4-11-3 | TTTTaaccagagtggCAT | 676_1 | -23.21 | EX-EX |
| 677 | TTTTAACCAGAGTGGCATC | 4-13-2 | TTTTaaccagagtggcaTC | 677_1 | -22.57 | EX-EX |
| 678 | TTTTAACCAGAGTGGCATCC | 2-16-2 | TTttaaccagagtggcatCC | 678_1 | -24.58 | EX-EX |
| 679 | ATCAATATCTTCTCACT | 1-1-2-7-1-1-1-2 | AtCAatatcttCtCaCT | 679_1 | -19.16 | 5782 |
| 679 | ATCAATATCTTCTCACT | 5-6-1-2-3 | ATCAAtatcttCtcACT | 679_2 | -21.49 | 5782 |
| 679 | ATCAATATCTTCTCACT | 1-1-1-1-1-7-5 | AtCaAtatcttcTCACT | 679_3 | -20.18 | 5782 |
| 679 | ATCAATATCTTCTCACT | 1-1-3-8-4 | AtCAAtatcttctCACT | 679_4 | -20.66 | 5782 |
| 679 | ATCAATATCTTCTCACT | 3-10-1-1-2 | ATCaatatcttctCaCT | 679_5 | -18.62 | 5782 |
| 680 | TATCAATATCTTCTCACT | 2-2-1-7-1-1-1-2 | TAtcAatatcttCtCaCT | 680_1 | -19.31 | 5782 |
| 680 | TATCAATATCTTCTCACT | 1-1-2-8-1-1-1-2 | TaTCaatatcttCtCaCT | 680_2 | -19.89 | 5782 |
| 680 | TATCAATATCTTCTCACT | 1-2-3-6-1-2-3 | TatCAAtatcttCtcACT | 680_3 | -20.66 | 5782 |
| 680 | TATCAATATCTTCTCACT | 1-2-3-7-2-1-2 | TatCAAtatcttTCaCT | 680_4 | -20.99 | 5782 |
| 680 | TATCAATATCTTCTCACT | 2-1-1-10-4 | TAtCaatatcttctCACT | 680_5 | -20.89 | 5782 |
| 681 | TATCAATATCTTCTCAC | 4-7-2-1-3 | TATCaatatctTCtCAC | 681_1 | -21.30 | 5783 |
| 681 | TATCAATATCTTCTCAC | 1-2-2-6-2-1-3 | TatCAatatctTCtCAC | 681_2 | -19.73 | 5783 |
| 681 | TATCAATATCTTCTCAC | 2-1-1-8-5 | TAtCaatatcttCTCAC | 681_3 | -20.26 | 5783 |
| 681 | TATCAATATCTTCTCAC | 1-1-3-7-5 | TaTCAatatcttCTCAC | 681_4 | -21.74 | 5783 |
| 681 | TATCAATATCTTCTCAC | 5-9-3 | TATCAatatcttctCAC | 681_5 | -20.83 | 5783 |
| 682 | TTATCAATATCTTCTCAC | 1-1-1-1-2-6-2-2-2 | TtAtCAatatctTCtcAC | 682_1 | -18.32 | 5783 |
| 682 | TTATCAATATCTTCTCAC | 1-3-1-8-5 | TtatCaatatcttCTCAC | 682_2 | -19.71 | 5783 |
| 682 | TTATCAATATCTTCTCAC | 3-10-1-1-3 | TTAtcaatatcttCtCAC | 682_3 | -19.53 | 5783 |
| 682 | TTATCAATATCTTCTCAC | 2-1-2-8-1-1-3 | TTaTCaatatcttCtCAC | 682_4 | -20.20 | 5783 |
| 682 | TTATCAATATCTTCTCAC | 1-2-3-9-3 | TtaTCAatatcttctCAC | 682_5 | -19.47 | 5783 |
| 683 | TTATCAATATCTTCTCACT | 1-1-1-1-8-1-1-1-2 | TtAtCaatatcttCtCaCT | 683_1 | -19.45 | 5782 |
| 683 | TTATCAATATCTTCTCACT | 1-3-1-8-1-1-1-2 | TtatCaatatcttCtCaCT | 683_2 | -19.35 | 5782 |
| 683 | TTATCAATATCTTCTCACT | 1-1-1-1-8-1-2-3 | TtAtCaatatcttCtcACT | 683_3 | -19.33 | 5782 |
| 683 | TTATCAATATCTTCTCACT | 1-1-1-2-1-7-1-3-2 | TtAtcAatatcttCtcaCT | 683_4 | -18.18 | 5782 |
| 683 | TTATCAATATCTTCTCACT | 1-1-1-2-1-9-4 | TtAtcAatatcttctCACT | 683_5 | -19.84 | 5782 |
| 684 | ACCTTTCTTTAACCCTTT | 2-1-1-8-2-1-3 | ACcTttctttaaCCcTTT | 684_1 | -25.24 | 8113 |
| 684 | ACCTTTCTTTAACCCTTT | 2-10-1-1-1-1-2 | ACctttctttaaCcCtTT | 684_2 | -22.31 | 8113 |
| 684 | ACCTTTCTTTAACCCTTT | 1-1-1-9-1-1-1-2 | AcCtttctttaaCcCtTT | 684_3 | -22.01 | 8113 |
| 684 | ACCTTTCTTTAACCCTTT | 1-1-1-1-1-9-1-1-2 | AcCtTtctttaaccCtTT | 684_4 | -21.53 | 8113 |
| 684 | ACCTTTCTTTAACCCTTT | 1-1-1-11-1-1-2 | AcCtttctttaaccCtTT | 684_5 | -21.23 | 8113 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 685 | TACCTTTCTTTAACCCTTT | 1-2-1-8-1-1-1-2-2 | TacCttttctttaAcCctTT | 685_1 | -22.44 | 8113 |
| 685 | TACCTTTCTTTAACCCTTT | 1-2-1-1-1-7-1-1-1-2 | TacCtTtctttaaCcCtTT | 685_2 | -23.32 | 8113 |
| 685 | TACCTTTCTTTAACCCTTT | 2-1-1-10-1-1-3 | TAcCtttctttaacCcTTT | 685_3 | -24.28 | 8113 |
| 685 | TACCTTTCTTTAACCCTTT | 1-1-1-12-1-1-2 | TaCctttctttaaccCtTT | 685_4 | -22.13 | 8113 |
| 685 | TACCTTTCTTTAACCCTTT | 1-2-1-11-1-1-2 | TacCtttctttaaccCtTT | 685_5 | -22.23 | 8113 |
| 686 | ATACCTTTCTTTAACCC | 1-2-1-7-1-1-1-1-2 | AtaCctttctttTaAcCC | 686_1 | -20.53 | 8116 |
| 686 | ATACCTTTCTTTAACCC | 1-3-1-6-1-3-2 | AtacCtttcttTaacCC | 686_2 | -20.21 | 8116 |
| 686 | ATACCTTTCTTTAACCC | 2-1-1-7-2-1-2 | ATacCtttctttAAcCC | 686_3 | -21.89 | 8116 |
| 686 | ATACCTTTCTTTAACCC | 1-1-1-1-1-8-1-1-2 | AtAcCtttctttaAcCC | 686_4 | -20.10 | 8116 |
| 686 | ATACCTTTCTTTAACCC | 1-2-1-10-3 | AtaCctttctttaaCCC | 686_5 | -21.76 | 8116 |
| 687 | ATACCTTTCTTTAACCCTT | 1-3-2-6-1-2-4 | AtacCTttctttAacCCTT | 687_1 | -26.10 | 8114 |
| 687 | ATACCTTTCTTTAACCCTT | 1-1-1-1-1-8-1-1-1-2 | AtAcCtttctttaAcCcTT | 687_2 | -22.23 | 8114 |
| 687 | ATACCTTTCTTTAACCCTT | 1-2-1-9-1-1-1-2 | AtaCctttctttaAcCcTT | 687_3 | -21.93 | 8114 |
| 687 | ATACCTTTCTTTAACCCTT | 1-2-1-1-1-8-2-1-2 | AtaCcTttctttaaCCcTT | 687_4 | -24.41 | 8114 |
| 687 | ATACCTTTCTTTAACCCTT | 1-3-1-11-3 | AtacCtttctttaaccCTT | 687_5 | -22.51 | 8114 |
| 688 | ATACCTTTCTTTAACCCTTT | 1-3-1-8-1-1-1-2-2 | AtacCtttctttaAcCctTT | 688_1 | -22.83 | 8113 |
| 688 | ATACCTTTCTTTAACCCTTT | 1-3-1-9-1-1-1-1-2 | AtacCtttctttaaCcCtTT | 688_2 | -23.41 | 8113 |
| 688 | ATACCTTTCTTTAACCCTTT | 1-4-2-7-1-2-3 | AtaccTTtctttaaCccTTT | 688_3 | -23.98 | 8113 |
| 688 | ATACCTTTCTTTAACCCTTT | 1-1-1-1-1-10-1-1-3 | AtAcCtttctttaacCcTTT | 688_4 | -23.63 | 8113 |
| 688 | ATACCTTTCTTTAACCCTTT | 1-2-1-12-1-1-2 | AtaCctttctttaaccCtTT | 688_5 | -22.52 | 8113 |
| 689 | ATACCTTTCTTTAACCCT | 1-3-2-6-2-2-2 | AtacCTttctttAAccCT | 689_1 | -22.61 | 8115 |
| 689 | ATACCTTTCTTTAACCCT | 1-1-1-1-2-8-1-1-2 | AtAcCTttctttaaCcCT | 689_2 | -22.85 | 8115 |
| 689 | ATACCTTTCTTTAACCCT | 1-2-1-10-1-1-2 | AtaCctttctttaaCcCT | 689_3 | -21.36 | 8115 |
| 689 | ATACCTTTCTTTAACCCT | 1-2-3-10-2 | AtaCCTttctttaaccCT | 689_4 | -24.26 | 8115 |
| 689 | ATACCTTTCTTTAACCCT | 1-3-1-11-2 | AtacCtttctttaaccCT | 689_5 | -20.69 | 8115 |
| 690 | TATACCTTTCTTTAACCCT | 2-2-1-10-1-1-2 | TAtaCctttctttaaCcCT | 690_1 | -23.60 | 8115 |
| 690 | TATACCTTTCTTTAACCCT | 1-4-1-9-1-1-2 | TatacCtttctttaaCcCT | 690_2 | -22.57 | 8115 |
| 690 | TATACCTTTCTTTAACCCT | 2-3-1-11-2 | TAtacCtttctttaaccCT | 690_3 | -22.92 | 8115 |
| 690 | TATACCTTTCTTTAACCCT | 1-3-1-12-2 | TataCctttctttaaccCT | 690_4 | -21.68 | 8115 |
| 690 | TATACCTTTCTTTAACCCT | 1-4-1-11-2 | TatacCtttctttaaccCT | 690_5 | -21.79 | 8115 |
| 691 | TTATACCTTTCTTTAAC | 4-7-2-2-2 | TTATaccttcTTtaAC | 691_1 | -18.49 | 8118 |
| 691 | TTATACCTTTCTTTAAC | 3-8-1-1-4 | TTAtaccttcTtTAAC | 691_2 | -18.07 | 8118 |
| 692 | TTATACCTTTCTTTAACCC | 2-10-1-1-2-2 | TTatacctttctTtAacCC | 692_1 | -21.94 | 8116 |
| 692 | TTATACCTTTCTTTAACCC | 1-1-1-9-1-4-2 | TtAtaccttctTtaacCC | 692_2 | -20.68 | 8116 |
| 692 | TTATACCTTTCTTTAACCC | 1-4-1-7-1-3-2 | TtataCcttcttTaacCC | 692_3 | -21.79 | 8116 |
| 692 | TTATACCTTTCTTTAACCC | 1-3-2-8-2-1-2 | TtatACcttcttttAAcCC | 692_4 | -22.39 | 8116 |

TABLE 3-continued

List of oligonucleotides or contiguous nucleobase sequences complementary to SEQ
ID NO: 1 (motif sequences indicated by SEQ ID NO), oligonucleotide designs made from these,
as well as specific oligonucleotide compounds (indicated by CMP ID NO) designed based on
the motif sequence.

| Seq ID NO | Motif | Design | Compound | CMP ID NO | ΔG° | Start SEQ ID NO 1 |
|---|---|---|---|---|---|---|
| 692 | TTATACCTTTCTTTAACCC | 1-1-1-2-1-9-1-1-2 | TtAtaCctttctttaAcCC | 692_5 | -21.58 | 8116 |
| 693 | TTATACCTTTCTTTAACC | 2-3-1-6-1-3-2 | TTataCctttctTtaaCC | 693_1 | -19.80 | 8117 |
| 693 | TTATACCTTTCTTTAACC | 1-1-1-1-2-6-1-3-2 | TtAtACctttctTtaaCC | 693_2 | -19.25 | 8117 |
| 693 | TTATACCTTTCTTTAACC | 1-3-2-7-2-1-2 | TtatACcttctttTAaCC | 693_3 | -20.74 | 8117 |
| 693 | TTATACCTTTCTTTAACC | 1-1-1-2-1-7-1-2-2 | TtAtaCctttctttTaaCC | 693_4 | -19.08 | 8117 |
| 693 | TTATACCTTTCTTTAACC | 1-2-1-1-1-8-4 | TtaTaCctttctttAACC | 693_5 | -20.26 | 8117 |
| 694 | TTTATACCTTTCTTTAACC | 2-1-1-8-2-3-2 | TTTAtaccttcTTtaaCC | 694_1 | -20.72 | 8117 |
| 694 | TTTATACCTTTCTTTAACC | 1-4-1-6-1-2-4 | TttatAcctttcTttAACC | 694_2 | -20.33 | 8117 |
| 694 | TTTATACCTTTCTTTAACC | 2-11-1-1-1-1-2 | TTtatacctttctTtAaCC | 694_3 | -19.72 | 8117 |
| 694 | TTTATACCTTTCTTTAACC | 1-1-2-9-1-3-2 | TtTAtaccttctTtaaCC | 694_4 | -20.65 | 8117 |
| 694 | TTTATACCTTTCTTTAACC | 1-3-2-7-1-3-2 | TttaTAccttctTtaaCC | 694_5 | -20.88 | 8117 |
| 695 | TTTATACCTTTCTTTAAC | 3-9-3-1-2 | TTTataccttcTTTaAC | 695_1 | -18.74 | 8118 |
| 695 | TTTATACCTTTCTTTAAC | 5-7-2-2-2 | TTTATaccttcTTtaAC | 695_2 | -20.31 | 8118 |
| 695 | TTTATACCTTTCTTTAAC | 1-1-3-7-2-2-2 | TtTATaccttcTTtaAC | 695_3 | -18.98 | 8118 |
| 695 | TTTATACCTTTCTTTAAC | 4-8-1-1-4 | TTTAtaccttcTtTAAC | 695_4 | -19.89 | 8118 |
| 695 | TTTATACCTTTCTTTAAC | 2-3-1-7-5 | TTtatAcctttctTTAAC | 695_5 | -18.02 | 8118 |
| 696 | TTTTATACCTTTCTTTAAC | 2-3-1-6-3-2-2 | TTttaTaccttttCTTtaAC | 696_1 | -19.79 | 8118 |
| 696 | TTTTATACCTTTCTTTAAC | 1-1-2-8-2-1-1-1-2 | TtTTataccttttCTtTaAC | 696_2 | -19.57 | 8118 |
| 696 | TTTTATACCTTTCTTTAAC | 2-1-2-7-2-2-3 | TTtTAaccttttCTttAAC | 696_3 | -20.28 | 8118 |
| 696 | TTTTATACCTTTCTTTAAC | 3-9-1-1-5 | TTTtataccttttCtTTAAC | 696_4 | -20.62 | 8118 |
| 696 | TTTTATACCTTTCTTTAAC | 1-1-3-7-1-1-1-2-2 | TtTTtaccttttCtTtaAC | 696_5 | -19.08 | 8118 |
| 697 | TGTACTTTCCTTTACCA | 2-9-1-3-2 | TGtactttcctTtacCA | 697_1 | -20.68 | 11462 |
| 697 | TGTACTTTCCTTTACCA | 1-2-1-7-1-3-2 | TgtActttcctTtacCA | 697_2 | -19.66 | 11462 |
| 697 | TGTACTTTCCTTTACCA | 1-3-1-6-1-3-2 | TgtaCtttcctTtacCA | 697_3 | -20.46 | 11462 |
| 697 | TGTACTTTCCTTTACCA | 2-2-1-8-1-1-2 | TGtaCtttcctttAcCA | 697_4 | -21.56 | 11462 |
| 697 | TGTACTTTCCTTTACCA | 1-3-1-9-3 | TgtaCtttcctttaCCA | 697_5 | -22.54 | 11462 |
| 698 | TTATACACCATCATTAT | 4-7-3-1-2 | TTATacaccatCATTAT | 698_1 | -21.13 | 11506 |
| 698 | TTATACACCATCATTAT | 4-7-2-1-3 | TTATacaccatCAtTAT | 698_2 | -21.64 | 11506 |
| 698 | TTATACACCATCATTAT | 3-8-1-1-4 | TTAtacaccatCaTTAT | 698_3 | -19.45 | 11506 |
| 698 | TTATACACCATCATTAT | 2-1-2-7-5 | TTaTAcaccatcATTAT | 698_4 | -20.61 | 11506 |
| 698 | TTATACACCATCATTAT | 5-9-3 | TTATAcaccatcatTAT | 698_5 | -20.74 | 11506 |
| 699 | TTATACACCATCATTATA | 3-2-1-6-2-2-2 | TTAtaCaccatcATtaTA | 699_1 | -19.38 | 11505 |
| 699 | TTATACACCATCATTATA | 1-2-3-6-1-1-4 | TtaTACaccatcAtTATA | 699_2 | -20.93 | 11505 |
| 699 | TTATACACCATCATTATA | 4-1-1-7-2-1-2 | TTATaCaccatcaTTaTA | 699_3 | -21.44 | 11505 |
| 699 | TTATACACCATCATTATA | 2-1-2-8-1-1-3 | TTaTAcaccatcaTtATA | 699_4 | -19.71 | 11505 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 699 | TTATACACCATCATTATA | 3-2-1-8-4 | TTAtaCaccatcatTATA | 699_5 | -20.75 | 11505 |
| 700 | TTTATACACCATCATTAT | 2-1-2-7-3-1-2 | TTtATacaccatCATtAT | 700_1 | -20.67 | 11506 |
| 700 | TTTATACACCATCATTAT | 3-1-1-7-2-1-3 | TTTaTacaccatCAtTAT | 700_2 | -21.52 | 11506 |
| 700 | TTTATACACCATCATTAT | 1-3-2-6-2-1-3 | TttaTAcaccatCAtTAT | 700_3 | -20.70 | 11506 |
| 700 | TTTATACACCATCATTAT | 1-1-3-8-1-1-3 | TtTATacaccatcAtTAT | 700_4 | -20.05 | 11506 |
| 700 | TTTATACACCATCATTAT | 3-1-1-9-4 | TTTaTacaccatcaTTAT | 700_5 | -20.34 | 11506 |
| 701 | TTTATACACCATCATTATA | 4-8-1-1-2-1-2 | TTTAtacaccatCaTTaTA | 701_1 | -21.57 | 11505 |
| 701 | TTTATACACCATCATTATA | 2-2-1-7-1-2-4 | TTtaTacaccatCatTATA | 701_2 | -21.05 | 11505 |
| 701 | TTTATACACCATCATTATA | 1-1-1-1-1-8-2-1-3 | TtTaTacaccatcATtATA | 701_3 | -19.83 | 11505 |
| 701 | TTTATACACCATCATTATA | 2-2-2-7-2-2-2 | TTtaTAcaccatcATtaTA | 701_4 | -20.24 | 11505 |
| 701 | TTTATACACCATCATTATA | 1-1-3-10-1-1-2 | TtTATacaccatcatTaTA | 701_5 | -20.30 | 11505 |
| 702 | ATTTATACACCATCATTAT | 1-1-1-2-1-7-3-1-2 | AtTtaTacaccatCATtAT | 702_1 | -20.07 | 11506 |
| 702 | ATTTATACACCATCATTAT | 1-1-2-1-1-7-2-2-2 | AtTTaTacaccatCAttAT | 702_2 | -20.07 | 11506 |
| 702 | ATTTATACACCATCATTAT | 2-1-2-8-1-1-1-2 | ATtTAtacaccatCaTtAT | 702_3 | -19.74 | 11506 |
| 702 | ATTTATACACCATCATTAT | 2-3-1-7-1-2-3 | ATttaTacaccatCatTAT | 702_4 | -20.07 | 11506 |
| 702 | ATTTATACACCATCATTAT | 1-1-1-1-1-10-4 | AtTtAtacaccatcaTTAT | 702_5 | -18.64 | 11506 |
| 703 | ATTTATACACCATCATTATA | 1-4-1-7-1-2-4 | AtttaTacaccatCatTATA | 703_1 | -21.05 | 11505 |
| 703 | ATTTATACACCATCATTATA | 2-1-1-2-1-7-2-2-2 | ATtTatAcaccatcATtaTA | 703_2 | -20.32 | 11505 |
| 703 | ATTTATACACCATCATTATA | 1-1-1-2-1-8-1-1-1-2 | AtTtaTacaccatcAtTaTA | 703_3 | -18.80 | 11505 |
| 703 | ATTTATACACCATCATTATA | 1-2-3-8-1-1-1-2 | AttTAtacaccatcAtTaTA | 703_4 | -21.17 | 11505 |
| 703 | ATTTATACACCATCATTATA | 3-1-1-9-1-2-3 | ATTTAtacaccatcAttATA | 703_5 | -19.97 | 11505 |
| 704 | TATTTATACACCATCATTA | 1-2-3-6-2-3-2 | TatTTAtacaccATcatTA | 704_1 | -20.37 | 11507 |
| 704 | TATTTATACACCATCATTA | 4-8-1-1-2-1-2 | TATTtatacaccAtCAtTA | 704_2 | -21.70 | 11507 |
| 704 | TATTTATACACCATCATTA | 1-1-1-1-1-7-1-1-1-3 | TaTtTatacaccAtCaTTA | 704_3 | -19.16 | 11507 |
| 704 | TATTTATACACCATCATTA | 2-2-1-8-2-2-2 | TAttTatacaccaTCatTA | 704_4 | -19.98 | 11507 |
| 704 | TATTTATACACCATCATTA | 2-2-1-10-4 | TAttTatacaccatcATTA | 704_5 | -19.99 | 11507 |
| 705 | TATTTATACACCATCATTAT | 2-2-1-1-1-7-2-2-2 | TAttTaTacaccatCAttAT | 705_1 | -21.49 | 11506 |
| 705 | TATTTATACACCATCATTAT | 2-1-1-10-1-1-4 | TAtTtatacaccatCaTTAT | 705_2 | -21.44 | 11506 |
| 705 | TATTTATACACCATCATTAT | 1-1-1-2-1-8-1-1-1-2 | TaTttAtacaccatCaTtAT | 705_3 | -18.27 | 11506 |
| 705 | TATTTATACACCATCATTAT | 2-1-2-9-1-3-2 | TAtTTatacaccatCattAT | 705_4 | -19.97 | 11506 |
| 705 | TATTTATACACCATCATTAT | 1-2-3-9-1-1-3 | TatTTAtacaccatcAtTAT | 705_5 | -21.11 | 11506 |
| 706 | TTATTTATACACCATCATTA | 2-3-1-7-1-1-1-3 | TTattTatacaccAtCaTTA | 706_1 | -20.54 | 11507 |
| 706 | TTATTTATACACCATCATTA | 1-1-2-1-1-7-1-2-4 | TtATtTatacaccAtcATTA | 706_2 | -20.84 | 11507 |
| 706 | TTATTTATACACCATCATTA | 1-1-2-1-8-2-2-2 | TtAttTatacaccaTCatTA | 706_3 | -19.52 | 11507 |
| 706 | TTATTTATACACCATCATTA | 1-2-3-8-1-1-1-2 | TtaTTTatacaccaTcAtTA | 706_4 | -19.96 | 11507 |
| 706 | TTATTTATACACCATCATTA | 3-1-1-11-1-1-2 | TTAtTtatacaccatcAtTA | 706_5 | -19.63 | 11507 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 707 | ATTATTTATACACCATCAT | 2-2-2-6-3-2-2 | ATtaTTtatacaCCAtcAT | 707_1 | −22.41 | 11509 |
| 707 | ATTATTTATACACCATCAT | 2-3-1-6-1-2-4 | ATtatTtatacaCcaTCAT | 707_2 | −21.02 | 11509 |
| 707 | ATTATTTATACACCATCAT | 1-1-1-1-1-8-3-1-2 | AtTaTtttatacacCATcAT | 707_3 | −20.01 | 11509 |
| 707 | ATTATTTATACACCATCAT | 1-1-2-1-1-7-1-2-3 | AtTAtTtatacacCatCAT | 707_4 | −20.30 | 11509 |
| 707 | ATTATTTATACACCATCAT | 2-1-2-9-1-1-3 | ATtATttataccAtCAT | 707_5 | −20.20 | 11509 |
| 708 | ATTATTTATACACCATCA | 2-2-2-6-2-2-2 | ATtaTTtatacaCCatCA | 708_1 | −20.96 | 11510 |
| 708 | ATTATTTATACACCATCA | 3-1-1-7-1-1-4 | ATTaTttatacaCcATCA | 708_2 | −21.19 | 11510 |
| 708 | ATTATTTATACACCATCA | 1-1-3-7-1-3-2 | AtTATttatacaCcatCA | 708_3 | −19.39 | 11510 |
| 708 | ATTATTTATACACCATCA | 1-1-1-2-1-7-2-1-2 | AtTatTtatacacCAtCA | 708_4 | −18.57 | 11510 |
| 708 | ATTATTTATACACCATCA | 2-1-2-8-1-1-3 | ATTATttatacacCaTCA | 708_5 | −19.79 | 11510 |
| 709 | ATTATTTATACACCATCATT | 1-2-3-7-1-1-2-1-2 | AttATTtatacacCaTCaTT | 709_1 | −20.97 | 11508 |
| 709 | ATTATTTATACACCATCATT | 1-1-1-2-2-6-1-4-2 | AtTatTTatacacCatcaTT | 709_2 | −19.29 | 11508 |
| 709 | ATTATTTATACACCATCATT | 1-1-1-2-1-8-2-1-3 | AtTatTtataccATcATT | 709_3 | −19.70 | 11508 |
| 709 | ATTATTTATACACCATCATT | 3-1-1-9-1-1-1-1-2 | ATTaTttataccAtCaTT | 709_4 | −20.09 | 11508 |
| 709 | ATTATTTATACACCATCATT | 2-1-2-1-1-7-1-2-3 | ATtATtTatacaccAtcATT | 709_5 | −20.67 | 11508 |
| 710 | ATTATTTATACACCATC | 5-6-3-1-2 | ATTATttatacACCaTC | 710_1 | −21.70 | 11511 |
| 710 | ATTATTTATACACCATC | 5-6-2-1-3 | ATTATttatacACcATC | 710_2 | −20.38 | 11511 |
| 710 | ATTATTTATACACCATC | 2-2-1-7-5 | ATtaTttatacaCCATC | 710_3 | −20.25 | 11511 |
| 710 | ATTATTTATACACCATC | 1-1-2-8-5 | AtTAtttatacaCCATC | 710_4 | −20.42 | 11511 |
| 710 | ATTATTTATACACCATC | 5-8-4 | ATTATttatacacCATC | 710_5 | −21.04 | 11511 |
| 711 | AATTATTTATACACCATC | 2-2-2-6-3-1-2 | AAttATttatacACCaTC | 711_1 | −18.93 | 11511 |
| 711 | AATTATTTATACACCATC | 2-1-3-6-1-1-4 | AAtTATttatacAcCATC | 711_2 | −20.18 | 11511 |
| 711 | AATTATTTATACACCATC | 4-1-1-7-5 | AATTaTttatacaCCATC | 711_3 | −22.24 | 11511 |
| 711 | AATTATTTATACACCATC | 2-1-2-8-5 | AAtTAtttatacaCCATC | 711_4 | −21.17 | 11511 |
| 711 | AATTATTTATACACCATC | 1-1-4-7-2-1-2 | AaTTATttatacaCCaTC | 711_5 | −20.58 | 11511 |
| 712 | AATTATTTATACACCATCA | 1-2-1-1-1-6-3-2-2 | AatTaTttatacACCatCA | 712_1 | −20.42 | 11510 |
| 712 | AATTATTTATACACCATCA | 2-2-1-7-1-1-2-1-2 | AAttAtttatacAcCAtCA | 712_2 | −18.54 | 11510 |
| 712 | AATTATTTATACACCATCA | 1-1-3-7-1-2-4 | AaTTAtttatacAccATCA | 712_3 | −20.67 | 11510 |
| 712 | AATTATTTATACACCATCA | 2-1-2-8-2-1-3 | AAtTAtttatacaCCaTCA | 712_4 | −22.20 | 11510 |
| 712 | AATTATTTATACACCATCA | 3-1-1-8-1-2-3 | AATtAtttatacaCcaTCA | 712_5 | −19.50 | 11510 |
| 713 | AAATTATTTATACACCATC | 3-2-1-6-3-1-3 | AAAttAtttataCACcATC | 713_1 | −19.21 | 11511 |
| 713 | AAATTATTTATACACCATC | 1-2-3-6-3-2-2 | AaaTTAtttataCACCcaTC | 713_2 | −20.01 | 11511 |
| 713 | AAATTATTTATACACCATC | 1-1-3-7-2-1-4 | AaATTatttataCAcCATC | 713_3 | −21.68 | 11511 |
| 713 | AAATTATTTATACACCATC | 2-1-2-7-1-1-2-1-2 | AAaTTatttataCaCCaTC | 713_4 | −19.63 | 11511 |
| 713 | AAATTATTTATACACCATC | 1-1-2-1-1-8-5 | AaATtAtttatacaCCATC | 713_5 | −20.67 | 11511 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 714 | AAATTATTTATACACCAT | 1-1-4-6-2-1-3 | AaATTAtttataCAcCAT | 714_1 | −20.31 | 11512 |
| 714 | AAATTATTTATACACCAT | 2-2-2-6-1-1-4 | AAatTAtttataCaCCAT | 714_2 | −19.59 | 11512 |
| 714 | AAATTATTTATACACCAT | 1-1-3-7-1-1-4 | AaATTatttataCaCCAT | 714_3 | −20.00 | 11512 |
| 714 | AAATTATTTATACACCAT | 4-9-5 | AAATtatttatacACCAT | 714_4 | −19.36 | 11512 |
| 714 | AAATTATTTATACACCAT | 3-1-2-7-5 | AAAtTAtttatacACCAT | 714_5 | −19.98 | 11512 |
| 715 | AAAATTATTTATACACCAT | 2-1-2-7-3-1-3 | AAaATtatttatACAcCAT | 715_1 | −19.29 | 11512 |
| 715 | AAAATTATTTATACACCAT | 1-3-2-6-2-1-4 | AaaaTTatttatACaCCAT | 715_2 | −19.68 | 11512 |
| 715 | AAAATTATTTATACACCAT | 3-2-1-6-1-1-5 | AAAatTatttatAcACCAT | 715_3 | −19.27 | 11512 |
| 715 | AAAATTATTTATACACCAT | 1-1-4-7-1-1-4 | AaAATTatttataCaCCAT | 715_4 | −20.75 | 11512 |
| 715 | AAAATTATTTATACACCAT | 2-1-2-9-5 | AAaATtatttatacACCAT | 715_5 | −19.38 | 11512 |
| 716 | TAAAATTATTTATACACC | 2-1-3-6-3-1-2 | TAaAATtatttaTACaCC | 716_1 | −18.88 | 11514 |
| 716 | TAAAATTATTTATACACC | 3-1-2-7-5 | TAAaATtatttatACACC | 716_2 | −18.95 | 11514 |
| 716 | TAAAATTATTTATACACC | 1-1-4-7-5 | TaAAATtatttatACACC | 716_3 | −18.33 | 11514 |
| 716 | TAAAATTATTTATACACC | 3-1-2-8-4 | TAAaATtatttataCACC | 716_4 | −18.35 | 11514 |
| 716 | TAAAATTATTTATACACC | 2-1-3-8-4 | TAaAATtatttataCACC | 716_5 | −18.35 | 11514 |
| 717 | GTAAAATTATTTATACACC | 2-1-3-6-4-1-2 | GTaAAAttatttATACaCC | 717_1 | −21.68 | 11514 |
| 717 | GTAAAATTATTTATACACC | 3-2-1-6-2-2-3 | GTAaaAttatttATacACC | 717_2 | −20.00 | 11514 |
| 717 | GTAAAATTATTTATACACC | 3-1-2-7-2-1-3 | GTAaAAttatttaTAcACC | 717_3 | −20.86 | 11514 |
| 717 | GTAAAATTATTTATACACC | 2-1-3-7-1-1-4 | GTaAAAttatttaTaCACC | 717_4 | −21.11 | 11514 |
| 717 | GTAAAATTATTTATACACC | 4-1-1-8-5 | GTAAaAttatttatACACC | 717_5 | −21.46 | 11514 |
| 718 | GTAAAATTATTTATACAC | 4-1-1-7-5 | GTAAaAttatttaTACAC | 718_1 | −18.17 | 11515 |
| 718 | GTAAAATTATTTATACAC | 3-1-2-7-5 | GTAaAAttatttaTACAC | 718_2 | −18.17 | 11515 |
| 719 | GAGTATATTACCTCCA | 3-10-3 | GAGtatattacctCCA | 719_1 | −22.56 | 15162 |
| 719 | GAGTATATTACCTCCA | 2-1-1-9-3 | GAgTatattacctCCA | 719_2 | −22.24 | 15162 |
| 719 | GAGTATATTACCTCCA | 2-11-3 | GAgtatattacctCCA | 719_3 | −21.15 | 15162 |
| 719 | GAGTATATTACCTCCA | 1-1-3-8-3 | GaGTAtattacctCCA | 719_4 | −22.93 | 15162 |
| 719 | GAGTATATTACCTCCA | 5-9-2 | GAGTAtattacctcCA | 719_5 | −23.29 | 15162 |
| 720 | CTTTTCTATAATCTCAC | 2-2-1-6-3-1-2 | CTttTctataaTCTcAC | 720_1 | −18.54 | 30553 |
| 720 | CTTTTCTATAATCTCAC | 3-8-2-1-3 | CTTttctataaTCtCAC | 720_2 | −19.80 | 30553 |
| 720 | CTTTTCTATAATCTCAC | 1-1-3-6-1-1-4 | CtTTTctataaTcTCAC | 720_3 | −19.40 | 30553 |
| 720 | CTTTTCTATAATCTCAC | 4-8-5 | CTTTtctataatCTCAC | 720_4 | −21.37 | 30553 |
| 720 | CTTTTCTATAATCTCAC | 1-3-1-7-5 | CtttTctataatCTCAC | 720_5 | −18.92 | 30553 |
| 721 | CTTTTCTATAATCTCACA | 2-3-1-6-1-1-1-2 | CTtttCtataatCtCaCA | 721_1 | −20.17 | 30552 |
| 721 | CTTTTCTATAATCTCACA | 1-1-1-1-2-6-1-2-3 | CtTtTCtataatCtcACA | 721_2 | −20.15 | 30552 |
| 721 | CTTTTCTATAATCTCACA | 1-2-1-1-1-7-2-1-2 | CttTtCtataatcTCaCA | 721_3 | −19.50 | 30552 |
| 721 | CTTTTCTATAATCTCACA | 1-1-3-8-1-1-3 | CtTTTctataatcTcACA | 721_4 | −19.49 | 30552 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 721 | CTTTTCTATAATCTCACA | 3-2-1-8-4 | CTTttCtataatctCACA | 721_5 | −21.97 | 30552 |
| 722 | TCTTTTCTATAATCTCACA | 1-1-3-7-1-1-1-3 | TcTTTtctataaTcTcACA | 722_1 | −21.04 | 30552 |
| 722 | TCTTTTCTATAATCTCACA | 1-4-1-6-1-2-1-1-2 | TctttTctataaTctCaCA | 722_2 | −18.81 | 30552 |
| 722 | TCTTTTCTATAATCTCACA | 2-2-1-8-1-2-3 | TCttTtctataatCtcACA | 722_3 | −20.68 | 30552 |
| 722 | TCTTTTCTATAATCTCACA | 2-1-1-9-1-3-2 | TCtTttctataatCtcaCA | 722_4 | −20.13 | 30552 |
| 722 | TCTTTTCTATAATCTCACA | 2-13-1-1-2 | TCttttctataatctCaCA | 722_5 | −19.52 | 30552 |
| 723 | TCTTTTCTATAATCTCAC | 2-1-1-8-2-2-2 | TCtTttctataaTctcAC | 723_1 | −18.51 | 30553 |
| 723 | TCTTTTCTATAATCTCAC | 3-10-1-1-3 | TCTttctataatCtCAC | 723_2 | −20.36 | 30553 |
| 723 | TCTTTTCTATAATCTCAC | 1-2-3-7-1-1-3 | TctTTTctataatCtCAC | 723_3 | −19.57 | 30553 |
| 723 | TCTTTTCTATAATCTCAC | 2-2-2-8-4 | TCttTTctataatcTCAC | 723_4 | −20.57 | 30553 |
| 723 | TCTTTTCTATAATCTCAC | 1-1-4-8-4 | TcTTTTctataatcTCAC | 723_5 | −20.82 | 30553 |
| 724 | ATCTTTTCTATAATCTCACA | 1-1-1-1-1-9-1-1-1-2 | AtCtTttctataatCtCaCA | 724_1 | −20.93 | 30552 |
| 724 | ATCTTTTCTATAATCTCACA | 1-1-1-11-1-2-3 | AtCttttctataatCtcACA | 724_2 | −20.51 | 30552 |
| 724 | ATCTTTTCTATAATCTCACA | 1-2-1-1-1-8-1-2-3 | AtcttTtctataatCtcACA | 724_3 | −20.35 | 30552 |
| 724 | ATCTTTTCTATAATCTCACA | 1-3-2-8-1-3-2 | AtctTTtctataatCtcaCA | 724_4 | −20.10 | 30552 |
| 724 | ATCTTTTCTATAATCTCACA | 1-1-1-2-1-10-1-1-2 | AtCttTtctataatctCaCA | 724_5 | −19.95 | 30552 |
| 725 | ATCTTTTCTATAATCTCAC | 1-1-1-9-1-1-1-3 | AtCttttctataAtCtCAC | 725_1 | −19.62 | 30553 |
| 725 | ATCTTTTCTATAATCTCAC | 1-2-2-7-1-1-1-3 | AtcttttctataAtCtCAC | 725_2 | −19.97 | 30553 |
| 725 | ATCTTTTCTATAATCTCAC | 1-1-2-1-1-7-2-2-2 | AtCTtTtctataaTCtcAC | 725_3 | −19.83 | 30553 |
| 725 | ATCTTTTCTATAATCTCAC | 1-2-1-1-1-9-4 | AtcttTtctataatcTCAC | 725_4 | −19.36 | 30553 |
| 725 | ATCTTTTCTATAATCTCAC | 3-13-3 | ATCttttctataatctCAC | 725_5 | −20.25 | 30553 |
| 726 | ATCTTTTCTATAATCTCA | 1-1-2-8-1-1-1-2 | AtCTttctataAtCtCA | 726_1 | −18.77 | 30554 |
| 726 | ATCTTTTCTATAATCTCA | 3-1-1-7-1-2-3 | ATCtTttctataAtcTCA | 726_2 | −20.03 | 30554 |
| 726 | ATCTTTTCTATAATCTCA | 3-10-2-1-2 | ATCttttctataaTCtCA | 726_3 | −20.31 | 30554 |
| 726 | ATCTTTTCTATAATCTCA | 1-1-1-1-2-7-2-1-2 | AtCtTTtctataaTCtCA | 726_4 | −19.49 | 30554 |
| 726 | ATCTTTTCTATAATCTCA | 1-1-3-9-4 | AtCTTtctataatCTCA | 726_5 | −21.14 | 30554 |
| 727 | CATCTTTTCTATAATCTCAC | 2-11-1-1-1-2-2 | CAtcttttctataAtCtcAC | 727_1 | −19.86 | 30553 |
| 727 | CATCTTTTCTATAATCTCAC | 1-1-2-9-1-1-1-2-2 | CaTCttttctataAtCtcAC | 727_2 | −20.49 | 30553 |
| 727 | CATCTTTTCTATAATCTCAC | 1-3-1-1-1-8-1-1-3 | CatcTtTtctataatCtCAC | 727_3 | −20.97 | 30553 |
| 727 | CATCTTTTCTATAATCTCAC | 1-2-1-1-1-9-1-2-2 | CatCtTttctataatCtcAC | 727_4 | −19.35 | 30553 |
| 727 | CATCTTTTCTATAATCTCAC | 2-1-1-2-1-10-3 | CAtCttTtctataatctCAC | 727_5 | −21.92 | 30553 |
| 728 | CATCTTTTCTATAATCTCA | 1-3-1-7-2-1-1-2 | CatcTttttctatAAtCtCA | 728_1 | −19.26 | 30554 |
| 728 | CATCTTTTCTATAATCTCA | 2-3-1-6-2-2-3 | CAtctTttctatAAtcTCA | 728_2 | −20.74 | 30554 |
| 728 | CATCTTTTCTATAATCTCA | 1-2-1-8-1-2-1-1-2 | CatCttttctatAatCtCA | 728_3 | −19.21 | 30554 |
| 728 | CATCTTTTCTATAATCTCA | 2-1-1-1-1-9-1-1-2 | CAtCtTttctataatCtCA | 728_4 | −20.86 | 30554 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 728 | CATCTTTTCTATAATCTCA | 1-1-2-13-2 | CaTCttttctataatctCA | 728_5 | -19.23 | 30554 |
| 729 | TCATCTTTTCTATAATCTCA | 1-1-1-2-1-7-2-1-1-1-2 | TcAtcTtttctatAAtCtCA | 729_1 | -20.53 | 30554 |
| 729 | TCATCTTTTCTATAATCTCA | 2-4-1-6-2-3-2 | TCatctTttctatAAtctCA | 729_2 | -20.57 | 30554 |
| 729 | TCATCTTTTCTATAATCTCA | 2-2-1-8-1-2-1-1-2 | TCatCttttctatAatCtCA | 729_3 | -21.70 | 30554 |
| 729 | TCATCTTTTCTATAATCTCA | 3-13-1-1-2 | TCAtcttttctataatCtCA | 729_4 | -22.07 | 30554 |
| 729 | TCATCTTTTCTATAATCTCA | 3-1-1-13-2 | TCAtCttttctataatctCA | 729_5 | -22.07 | 30554 |
| 730 | TCATCTTTTCTATAATCTC | 3-2-1-7-2-2-2 | TCAtcTtttctatAAtcTC | 730_1 | -20.15 | 30555 |
| 730 | TCATCTTTTCTATAATCTC | 3-1-1-8-1-3-2 | TCAtCttttctatAatcTC | 730_2 | -20.09 | 30555 |
| 730 | TCATCTTTTCTATAATCTC | 2-2-1-9-1-2-2 | TCatCttttctataAtcTC | 730_3 | -18.83 | 30555 |
| 730 | TCATCTTTTCTATAATCTC | 3-13-3 | TCAtcttttctataatCTC | 730_4 | -20.65 | 30555 |
| 730 | TCATCTTTTCTATAATCTC | 2-2-2-10-3 | TCatCTtttctataatCTC | 730_5 | -21.35 | 30555 |
| 731 | GTCATCTTTTCTATAATC | 1-1-1-2-1-6-3-1-2 | GtCatCttttctATAaTC | 731_1 | -19.76 | 30557 |
| 731 | GTCATCTTTTCTATAATC | 1-1-1-1-2-6-1-2-3 | GtCaTCttttctAtaATC | 731_2 | -19.19 | 30557 |
| 731 | GTCATCTTTTCTATAATC | 4-9-1-2-2 | GTCAtcttttctaTaaTC | 731_3 | -20.42 | 30557 |
| 731 | GTCATCTTTTCTATAATC | 3-2-1-8-4 | GTCatCttttctatAATC | 731_4 | -20.51 | 30557 |
| 731 | GTCATCTTTTCTATAATC | 1-1-4-10-2 | GtCATCttttctataaTC | 731_5 | -20.23 | 30557 |
| 732 | TGTCATCTTTTCTATAAT | 2-1-1-8-2-1-3 | TGtCatcttttcTAtAAT | 732_1 | -19.36 | 30558 |
| 732 | TGTCATCTTTTCTATAAT | 2-1-2-7-2-2-2 | TGtCAtcttttcTataAT | 732_2 | -20.51 | 30558 |
| 732 | TGTCATCTTTTCTATAAT | 1-1-3-7-1-3-2 | TgTCAtctttcTataAT | 732_3 | -19.51 | 30558 |
| 732 | TGTCATCTTTTCTATAAT | 4-10-4 | TGTCatcttttctaTAAT | 732_4 | -21.42 | 30558 |
| 732 | TGTCATCTTTTCTATAAT | 2-2-1-9-4 | TGtcAtcttttctaTAAT | 732_5 | -18.57 | 30558 |
| 733 | ACTTAATTATACTTCCA | 5-6-2-2-2 | ACTTAattataCTtcCA | 733_1 | -21.55 | 30664 |
| 733 | ACTTAATTATACTTCCA | 2-1-2-6-1-2-3 | ACtTAattataCttCCA | 733_2 | -21.02 | 30664 |
| 733 | ACTTAATTATACTTCCA | 1-2-2-7-5 | ActTAattatacTTCCA | 733_3 | -20.65 | 30664 |
| 733 | ACTTAATTATACTTCCA | 4-8-1-1-3 | ACTTaattatacTtCCA | 733_4 | -21.09 | 30664 |
| 733 | ACTTAATTATACTTCCA | 1-1-1-1-8-4 | AcTtAattatactTCCA | 733_5 | -18.37 | 30664 |
| 734 | CACTTAATTATACTTCC | 2-1-2-6-2-2-2 | CAcTTaattatACttCC | 734_1 | -20.10 | 30665 |
| 734 | CACTTAATTATACTTCC | 5-6-1-2-3 | CACTTaattatActTCC | 734_2 | -21.76 | 30665 |
| 734 | CACTTAATTATACTTCC | 1-1-1-1-1-7-2-1-2 | CaCtTaattataCTtCC | 734_3 | -19.09 | 30665 |
| 734 | CACTTAATTATACTTCC | 1-1-3-7-1-1-3 | CaCTTaattataCtTCC | 734_4 | -20.59 | 30665 |
| 734 | CACTTAATTATACTTCC | 2-1-2-8-4 | CAcTTaattatacTTCC | 734_5 | -20.52 | 30665 |
| 735 | CACTTAATTATACTTCCA | 2-2-1-7-2-1-3 | CActTaattataCTtCCA | 735_1 | -22.96 | 30664 |
| 735 | CACTTAATTATACTTCCA | 2-1-1-1-1-6-1-3-2 | CAcTtAattataCttcCA | 735_2 | -19.31 | 30664 |
| 735 | CACTTAATTATACTTCCA | 1-1-3-8-1-1-3 | CaCTTaattatacTtCCA | 735_3 | -22.43 | 30664 |
| 735 | CACTTAATTATACTTCCA | 1-1-1-1-2-7-1-2-2 | CaCtTAattatacTtcCA | 735_4 | -19.51 | 30664 |
| 735 | CACTTAATTATACTTCCA | 2-2-1-9-4 | CActTaattatactTCCA | 735_5 | -21.76 | 30664 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 736 | ACACTTAATTATACTTCCA | 1-1-2-1-1-6-2-3-2 | AcACtTaattatACttcCA | 736_1 | -20.93 | 30664 |
| 736 | ACACTTAATTATACTTCCA | 2-2-1-7-1-1-1-2-2 | ACacTtaattatAcTtcCA | 736_2 | -19.38 | 30664 |
| 736 | ACACTTAATTATACTTCCA | 1-1-1-1-1-8-1-2-3 | AcAcTtaattataCttCCA | 736_3 | -21.10 | 30664 |
| 736 | ACACTTAATTATACTTCCA | 1-1-1-2-1-9-4 | AcActTaattatactTCCA | 736_4 | -21.31 | 30664 |
| 736 | ACACTTAATTATACTTCCA | 2-2-2-11-2 | ACacTTaattatacttcCA | 736_5 | -19.91 | 30664 |
| 737 | ACACTTAATTATACTTCC | 1-3-1-7-2-1-3 | AcacTtaattatACtTCC | 737_1 | -19.24 | 30665 |
| 737 | ACACTTAATTATACTTCC | 1-1-1-1-2-6-2-2-2 | AcAcTTaattatACttCC | 737_2 | -19.64 | 30665 |
| 737 | ACACTTAATTATACTTCC | 2-1-2-7-1-1-1-2 | ACaCTtaattatAcTtCC | 737_3 | -20.12 | 30665 |
| 737 | ACACTTAATTATACTTCC | 3-2-1-8-4 | ACActTaattatacTTCC | 737_4 | -21.53 | 30665 |
| 737 | ACACTTAATTATACTTCC | 1-1-2-1-1-9-3 | AcACtTaattatactTCC | 737_5 | -19.40 | 30665 |
| 738 | ACACTTAATTATACTTC | 5-7-5 | ACACTtaattatACTTC | 738_1 | -20.47 | 30666 |
| 738 | ACACTTAATTATACTTC | 3-1-1-7-5 | ACAcTtaattatACTTC | 738_2 | -18.40 | 30666 |
| 738 | ACACTTAATTATACTTC | 2-1-2-7-5 | ACaCTtaattatACTTC | 738_3 | -18.51 | 30666 |
| 738 | ACACTTAATTATACTTC | 5-7-2-1-2 | ACACTtaattatACtTC | 738_4 | -18.77 | 30666 |
| 738 | ACACTTAATTATACTTC | 5-7-1-1-3 | ACACTtaattatAcTTC | 738_5 | -18.40 | 30666 |
| 738 | ACACTTAATTATACTTC | 5-8-4 | ACACTtaattataCTTC | 738_6 | -19.88 | 30666 |
| 739 | TACACTTAATTATACTTCC | 3-2-1-7-2-2 | TACacTtaattatACttCC | 739_1 | -21.57 | 30665 |
| 739 | TACACTTAATTATACTTCC | 1-4-1-7-1-1-4 | TacacTtaattatAcTTCC | 739_2 | -19.87 | 30665 |
| 739 | TACACTTAATTATACTTCC | 1-2-3-8-1-2-2 | TacACTtaattataCttCC | 739_3 | -20.88 | 30665 |
| 739 | TACACTTAATTATACTTCC | 4-11-4 | TACActtaattatacTTCC | 739_4 | -23.04 | 30665 |
| 739 | TACACTTAATTATACTTCC | 2-1-1-1-1-10-3 | TAcAcTtaattatactTCC | 739_5 | -20.03 | 30665 |
| 740 | TACACTTAATTATACTTC | 4-1-1-7-5 | TACAcTtaattatACTTC | 740_1 | -20.63 | 30666 |
| 740 | TACACTTAATTATACTTC | 3-1-2-7-5 | TACaCTtaattatACTTC | 740_2 | -20.74 | 30666 |
| 740 | TACACTTAATTATACTTC | 2-1-3-7-5 | TAcACTtaattatACTTC | 740_3 | -20.21 | 30666 |
| 740 | TACACTTAATTATACTTC | 3-1-2-8-4 | TACaCTtaattataCTTC | 740_4 | -20.14 | 30666 |
| 740 | TACACTTAATTATACTTC | 1-1-4-8-4 | TaCACTtaattataCTTC | 740_5 | -20.48 | 30666 |
| 741 | TTACACTTAATTATACTTC | 2-1-2-7-4-1-2 | TTaCacttaattATACtTC | 741_1 | -21.41 | 30666 |
| 741 | TTACACTTAATTATACTTC | 5-7-3-1-3 | TTACActtaattATAcTTC | 741_2 | -22.67 | 30666 |
| 741 | TTACACTTAATTATACTTC | 4-1-1-6-2-1-4 | TTACaCttaattATaCTTC | 741_3 | -22.54 | 30666 |
| 741 | TTACACTTAATTATACTTC | 2-1-2-7-2-1-4 | TTaCacttaattATAcTTC | 741_4 | -21.48 | 30666 |
| 741 | TTACACTTAATTATACTTC | 5-7-1-1-5 | TTACActtaattAtACTTC | 741_5 | -22.04 | 30666 |
| 742 | TTACACTTAATTATACTT | 5-7-3-1-2 | TTACActtaattATAcTT | 742_1 | -20.18 | 30667 |
| 742 | TTACACTTAATTATACTT | 5-7-2-1-3 | TTACActtaattATaCTT | 742_2 | -20.62 | 30667 |
| 742 | TTACACTTAATTATACTT | 5-7-1-1-4 | TTACActtaattAtACTT | 742_3 | -19.54 | 30667 |
| 743 | TTTACACTTAATTATACTT | 4-1-1-6-4-1-2 | TTTAcActtaatTATAcTT | 743_1 | -21.26 | 30667 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 743 | TTTACACTTAATTATACTT | 3-1-2-6-3-1-3 | TTTaCActtaatTATaCTT | 743_2 | -22.57 | 30667 |
| 743 | TTTACACTTAATTATACTT | 4-8-2-1-4 | TTTAcacttaatTAtACTT | 743_3 | -20.48 | 30667 |
| 743 | TTTACACTTAATTATACTT | 1-1-4-6-2-2-3 | TtTACActtaatTAtaCTT | 743_4 | -21.20 | 30667 |
| 743 | TTTACACTTAATTATACTT | 2-2-2-6-1-1-5 | TTtaCActtaatTaTACTT | 743_5 | -21.02 | 30667 |
| 744 | TTTACACTTAATTATACT | 3-1-2-6-3-1-2 | TTTaCActtaatTATaCT | 744_1 | -20.75 | 30668 |
| 744 | TTTACACTTAATTATACT | 1-1-4-6-3-1-2 | TtTACActtaatTATaCT | 744_2 | -21.06 | 30668 |
| 744 | TTTACACTTAATTATACT | 2-1-3-6-2-1-3 | TTtACActtaatTAtACT | 744_3 | -19.03 | 30668 |
| 744 | TTTACACTTAATTATACT | 4-8-1-1-4 | TTTAcacttaatTaTACT | 744_4 | -19.42 | 30668 |
| 744 | TTTACACTTAATTATACT | 1-1-1-1-2-6-1-1-4 | TtTaCActtaatTaTACT | 744_5 | -19.12 | 30668 |
| 745 | ATTTACACTTAATTATACT | 4-1-1-6-4-1-2 | ATTTaCacttaaTTTaTaCT | 745_1 | -22.20 | 30668 |
| 745 | ATTTACACTTAATTATACT | 2-1-3-6-3-1-3 | ATtTACacttaaTTAtACT | 745_2 | -21.43 | 30668 |
| 745 | ATTTACACTTAATTATACT | 5-7-2-1-4 | ATTTAcacttaaTTaTACT | 745_3 | -22.44 | 30668 |
| 745 | ATTTACACTTAATTATACT | 1-2-3-6-2-1-4 | AttTACacttaaTTaTACT | 745_4 | -20.95 | 30668 |
| 745 | ATTTACACTTAATTATACT | 3-1-2-6-1-1-5 | ATTTACacttaaTtATACT | 745_5 | -20.92 | 30668 |
| 746 | ATTTACACTTAATTATAC | 5-8-5 | ATTTAcacttaatTATAC | 746_1 | -19.94 | 30669 |
| 746 | ATTTACACTTAATTATAC | 4-1-1-7-5 | ATTTaCacttaatTATAC | 746_2 | -19.40 | 30669 |
| 746 | ATTTACACTTAATTATAC | 2-1-3-7-5 | ATtTACacttaatTATAC | 746_3 | -19.70 | 30669 |
| 747 | AATTTACACTTAATTATAC | 3-1-2-6-3-1-3 | AATtTAcacttaATTaTAC | 747_1 | -19.51 | 30669 |
| 747 | AATTTACACTTAATTATAC | 1-1-4-6-3-1-3 | AaTTTAcacttaATTaTAC | 747_2 | -19.51 | 30669 |
| 747 | AATTTACACTTAATTATAC | 4-8-2-1-4 | AATTtacacttaATTATAC | 747_3 | -18.04 | 30669 |
| 747 | AATTTACACTTAATTATAC | 5-7-1-1-5 | AATTTacacttaAtTATAC | 747_4 | -19.79 | 30669 |
| 747 | AATTTACACTTAATTATAC | 2-1-3-6-1-1-5 | AAtTTAcacttaAtTATAC | 747_5 | -19.26 | 30669 |
| 748 | AATTTACACTTAATTATACT | 3-2-2-6-4-1-2 | AATttACacttaaTTATaCT | 748_1 | -21.50 | 30668 |
| 748 | AATTTACACTTAATTATACT | 5-1-1-6-3-1-3 | AATTTACacttaaTTAtACT | 748_2 | -21.87 | 30668 |
| 748 | AATTTACACTTAATTATACT | 3-1-3-6-2-1-4 | AATtTACacttaaTTaTACT | 748_3 | -22.95 | 30668 |
| 748 | AATTTACACTTAATTATACT | 1-1-4-7-2-1-1-2 | AaTTTAcacttaaTTaTaCT | 748_4 | -20.23 | 30668 |
| 748 | AATTTACACTTAATTATACT | 2-1-2-1-1-6-1-1-5 | AAtTTaCacttaaTtATACT | 748_5 | -20.55 | 30668 |
| 749 | TAATTTACACTTAATTATAC | 2-1-4-6-4-1-2 | TAaTTTAcacttaATTAtAC | 749_1 | -20.98 | 30669 |
| 749 | TAATTTACACTTAATTATAC | 5-8-3-1-3 | TAATTtacacttaATTaTAC | 749_2 | -20.60 | 30669 |
| 749 | TAATTTACACTTAATTATAC | 2-2-3-6-3-1-3 | TAatTTAcacttaATTaTAC | 749_3 | -20.80 | 30669 |
| 749 | TAATTTACACTTAATTATAC | 4-1-2-6-2-1-4 | TAATtTAcacttaATTATAC | 749_4 | -21.41 | 30669 |
| 749 | TAATTTACACTTAATTATAC | 1-1-1-1-2-7-1-1-5 | TaAtTTacacttaAtTATAC | 749_5 | -18.92 | 30669 |
| 750 | TAATTTACACTTAATTAT | 5-8-5 | TAATTtacacttaATTAT | 750_1 | -18.27 | 30671 |
| 750 | TAATTTACACTTAATTAT | 4-1-1-7-5 | TAATtTacacttaATTAT | 750_2 | -18.18 | 30671 |
| 750 | TAATTTACACTTAATTAT | 2-1-3-7-5 | TAaTTTacacttaATTAT | 750_3 | -18.18 | 30671 |
| 750 | TAATTTACACTTAATTAT | 1-1-4-7-5 | TaATTTacacttaATTAT | 750_4 | -18.16 | 30671 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 751 | TAATTTACACTTAATTATA | 5-7-4-1-2 | TAATTtacacttAATTaTA | 751_1 | −18.87 | 30670 |
| 751 | TAATTTACACTTAATTATA | 5-7-2-1-4 | TAATTtacacttAAtTATA | 751_2 | −19.05 | 30670 |
| 751 | TAATTTACACTTAATTATA | 3-1-2-6-2-1-4 | TAAtTTacacttAAtTATA | 751_3 | −18.54 | 30670 |
| 751 | TAATTTACACTTAATTATA | 4-1-1-6-1-1-5 | TAATtTacacttAaTTATA | 751_4 | −19.40 | 30670 |
| 751 | TAATTTACACTTAATTATA | 2-1-3-6-1-1-5 | TAaTTTacacttAaTTATA | 751_5 | −19.41 | 30670 |
| 752 | TTAATTTACACTTAATTATA | 3-1-3-6-4-1-2 | TTAaTTTacacttAATTaTA | 752_1 | −20.61 | 30670 |
| 752 | TTAATTTACACTTAATTATA | 5-1-1-6-3-1-3 | TTAATtTacacttAATtATA | 752_2 | −20.28 | 30670 |
| 752 | TTAATTTACACTTAATTATA | 2-1-4-6-2-1-4 | TTaATTTacacttAAtTATA | 752_3 | −20.77 | 30670 |
| 752 | TTAATTTACACTTAATTATA | 3-2-2-6-1-1-5 | TTAatTTacacttAaTTATA | 752_4 | −20.28 | 30670 |
| 752 | TTAATTTACACTTAATTATA | 4-1-1-8-1-1-4 | TTAAtTtacacttaAtTATA | 752_5 | −18.80 | 30670 |
| 753 | TTAATTTACACTTAATTAT | 4-1-1-6-3-1-3 | TTAAtTtacactTAAtTAT | 753_1 | −18.65 | 30671 |
| 753 | TTAATTTACACTTAATTAT | 3-1-2-6-2-1-4 | TTAaTTacactTAaTTAT | 753_2 | −19.52 | 30671 |
| 753 | TTAATTTACACTTAATTAT | 2-1-2-7-2-1-4 | TTaATtacactTAaTTAT | 753_3 | −18.68 | 30671 |
| 753 | TTAATTTACACTTAATTAT | 5-7-1-1-5 | TTAATtacactTaATTAT | 753_4 | −20.00 | 30671 |
| 753 | TTAATTTACACTTAATTAT | 2-1-3-6-1-1-5 | TTaATTtacactTaATTAT | 753_5 | −19.47 | 30671 |
| 754 | TTTAATTTACACTTAATTA | 3-1-2-6-3-1-3 | TTTaATttacacTTAaTTA | 754_1 | −19.46 | 30672 |
| 754 | TTTAATTTACACTTAATTA | 5-7-2-1-4 | TTTAAtttacacTTaATTA | 754_2 | −19.54 | 30672 |
| 754 | TTTAATTTACACTTAATTA | 4-1-1-6-2-1-4 | TTTAaTttacacTTaATTA | 754_3 | −19.46 | 30672 |
| 754 | TTTAATTTACACTTAATTA | 1-1-1-1-2-6-2-1-4 | TtTaATttacacTTaATTA | 754_4 | −18.11 | 30672 |
| 754 | TTTAATTTACACTTAATTA | 1-1-4-7-3-1-2 | TtTAATttacactTAAtTA | 754_5 | −18.02 | 30672 |
| 755 | TTTAATTTACACTTAATTAT | 4-1-2-6-3-1-3 | TTTAaTTtacactTAAtTAT | 755_1 | −20.90 | 30671 |
| 755 | TTTAATTTACACTTAATTAT | 3-1-2-7-2-1-4 | TTTaATttacactTAaTTAT | 755_2 | −20.50 | 30671 |
| 755 | TTTAATTTACACTTAATTAT | 1-1-5-6-2-1-4 | TtTAATTtacactTAaTTAT | 755_3 | −21.34 | 30671 |
| 755 | TTTAATTTACACTTAATTAT | 5-8-1-1-5 | TTTAAtttacactTaATTAT | 755_4 | −20.58 | 30671 |
| 755 | TTTAATTTACACTTAATTAT | 2-2-3-6-1-1-5 | TTtaATTtacactTaATTAT | 755_5 | −20.05 | 30671 |
| 756 | ATTTAATTTACACTTAATTA | 5-1-1-6-4-1-2 | ATTTAaTttacacTTAAtTA | 756_1 | −21.11 | 30672 |
| 756 | ATTTAATTTACACTTAATTA | 3-2-2-6-3-1-3 | ATTtaATttacacTTAaTTA | 756_2 | −20.29 | 30672 |
| 756 | ATTTAATTTACACTTAATTA | 4-1-2-6-2-1-4 | ATTTaATttacacTTaATTA | 756_3 | −21.50 | 30672 |
| 756 | ATTTAATTTACACTTAATTA | 2-1-4-6-2-2-3 | ATtTAATttacacTTaaTTA | 756_4 | −20.39 | 30672 |
| 756 | ATTTAATTTACACTTAATTA | 2-1-4-8-5 | ATtTAATttacacttAATTA | 756_5 | −20.08 | 30672 |
| 757 | ATTTAATTTACACTTAATT | 5-7-3-1-3 | ATTTAatttacaCTTaATT | 757_1 | −20.52 | 30673 |
| 757 | ATTTAATTTACACTTAATT | 4-1-1-7-2-1-3 | ATTTaAtttacacTTaATT | 757_2 | −18.02 | 30673 |
| 757 | ATTTAATTTACACTTAATT | 2-1-3-7-2-1-3 | ATtAAtttacacTTaATT | 757_3 | −18.04 | 30673 |
| 757 | ATTTAATTTACACTTAATT | 4-1-1-8-5 | ATTTaAtttacactTAATT | 757_4 | −18.34 | 30673 |
| 757 | ATTTAATTTACACTTAATT | 2-1-3-8-5 | ATtTAAtttacactTAATT | 757_5 | −18.37 | 30673 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 758 | TATTTAATTTACACTTAAT | 3-1-2-6-4-1-2 | TATtTAatttacACTTaAT | 758_1 | -20.16 | 30674 |
| 758 | TATTTAATTTACACTTAAT | 2-1-3-6-2-1-4 | TAtTTAatttacACtTAAT | 758_2 | -19.37 | 30674 |
| 758 | TATTTAATTTACACTTAAT | 1-1-4-6-2-1-4 | TaTTTAatttacACtTAAT | 758_3 | -19.19 | 30674 |
| 758 | TATTTAATTTACACTTAAT | 3-1-2-6-1-1-5 | TATtTAatttacAcTTAAT | 758_4 | -19.44 | 30674 |
| 758 | TATTTAATTTACACTTAAT | 2-1-3-6-1-1-5 | TAtTTAatttacAcTTAAT | 758_5 | -19.00 | 30674 |
| 759 | TATTTAATTTACACTTAATT | 2-1-4-6-4-1-2 | TAtTTAAtttacaCTTAaTT | 759_1 | -21.54 | 30673 |
| 759 | TATTTAATTTACACTTAATT | 5-1-1-6-3-1-3 | TATTTaAtttacaCTTaATT | 759_2 | -21.92 | 30673 |
| 759 | TATTTAATTTACACTTAATT | 4-1-2-7-3-1-2 | TATTTAAtttacacTTAaTT | 759_3 | -19.35 | 30673 |
| 759 | TATTTAATTTACACTTAATT | 3-1-3-7-2-1-3 | TATtTAAtttacacTTaATT | 759_4 | -20.28 | 30673 |
| 759 | TATTTAATTTACACTTAATT | 2-1-4-8-5 | TAtTTAAtttacactTAATT | 759_5 | -20.16 | 30673 |
| 760 | CTATTTAATTTACACTT | 5-6-1-1-4 | CTATTtaatttAcACTT | 760_1 | -19.07 | 30677 |
| 760 | CTATTTAATTTACACTT | 5-7-5 | CTATTtaatttaCACTT | 760_2 | -20.97 | 30677 |
| 760 | CTATTTAATTTACACTT | 2-2-1-7-5 | CTatTtaatttaCACTT | 760_3 | -18.08 | 30677 |
| 760 | CTATTTAATTTACACTT | 5-7-2-1-2 | CTATTtaatttaCAcTT | 760_4 | -18.90 | 30677 |
| 760 | CTATTTAATTTACACTT | 5-7-1-1-3 | CTATTtaatttaCaCTT | 760_5 | -19.01 | 30677 |
| 761 | CTATTTAATTTACACTTAA | 2-1-3-6-4-1-2 | CTaTTTaatttaCACTTAA | 761_1 | -20.98 | 30675 |
| 761 | CTATTTAATTTACACTTAA | 3-1-2-6-3-1-3 | CTAtTTaatttaCACtTAA | 761_2 | -21.73 | 30675 |
| 761 | CTATTTAATTTACACTTAA | 4-1-1-6-2-1-4 | CTATtTaatttaCAcTTAA | 761_3 | -21.80 | 30675 |
| 761 | CTATTTAATTTACACTTAA | 5-7-2-2-3 | CTATTtaatttaCActTAA | 761_4 | -20.86 | 30675 |
| 761 | CTATTTAATTTACACTTAA | 2-1-3-6-1-1-5 | CTaTTTaatttaCaCTTAA | 761_5 | -21.29 | 30675 |
| 762 | CTATTTAATTTACACTTA | 5-7-3-1-2 | CTATTtaatttaCACtTA | 762_1 | -21.50 | 30676 |
| 762 | CTATTTAATTTACACTTA | 3-2-1-6-3-1-2 | CTAttTaatttaCACtTA | 762_2 | -20.17 | 30676 |
| 762 | CTATTTAATTTACACTTA | 3-1-1-7-2-1-3 | CTAtTtaatttaCAcTTA | 762_3 | -19.37 | 30676 |
| 762 | CTATTTAATTTACACTTA | 2-1-3-6-2-1-3 | CTaTTTaatttaCAcTTA | 762_4 | -20.43 | 30676 |
| 762 | CTATTTAATTTACACTTA | 2-1-3-6-1-1-4 | CTaTTTaatttaCaCTTA | 762_5 | -20.54 | 30676 |
| 763 | CTATTTAATTTACACTTAAT | 2-1-4-6-3-2-2 | CTaTTTAatttacACTtaAT | 763_1 | -21.79 | 30674 |
| 763 | CTATTTAATTTACACTTAAT | 4-1-2-6-2-1-4 | CTATtTAatttacACtTAAT | 763_2 | -23.29 | 30674 |
| 763 | CTATTTAATTTACACTTAAT | 1-2-4-6-1-1-5 | CtaTTTAatttacAcTTAAT | 763_3 | -20.68 | 30674 |
| 763 | CTATTTAATTTACACTTAAT | 3-1-3-6-1-1-2-1-2 | CTAtTTAatttacAcTTaAT | 763_4 | -21.14 | 30674 |
| 763 | CTATTTAATTTACACTTAAT | 5-1-1-7-3-1-2 | CTATTtAatttacaCTTaAT | 763_5 | -22.14 | 30674 |
| 764 | TCTATTTAATTTACACTTA | 2-1-3-6-4-1-2 | TCtATTtaatttACACtTA | 764_1 | -21.94 | 30676 |
| 764 | TCTATTTAATTTACACTTA | 4-1-1-6-3-1-3 | TCTAtTtaatttACAcTTA | 764_2 | -22.47 | 30676 |
| 764 | TCTATTTAATTTACACTTA | 3-1-2-7-2-1-3 | TCTaTTtaatttaCAcTTA | 764_3 | -21.69 | 30676 |
| 764 | TCTATTTAATTTACACTTA | 1-1-4-7-2-2-2 | TcTATTtaatttaCActTA | 764_4 | -20.33 | 30676 |
| 764 | TCTATTTAATTTACACTTA | 3-2-1-7-1-1-4 | TCTatTtaatttaCaCTTA | 764_5 | -20.85 | 30676 |
| 765 | TCTATTTAATTTACACTT | 3-2-1-6-2-1-3 | TCTatTtaatttACaCTT | 765_1 | -19.21 | 30677 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 765 | TCTATTTAATTTACACTT | 3-1-2-7-5 | TCTaTTtaatttaCACTT | 765_2 | -21.53 | 30677 |
| 765 | TCTATTTAATTTACACTT | 2-1-3-7-5 | TCtATTtaatttaCACTT | 765_3 | -20.81 | 30677 |
| 765 | TCTATTTAATTTACACTT | 4-1-1-7-2-1-2 | TCTAtTtaatttaCAcTT | 765_4 | -19.64 | 30677 |
| 765 | TCTATTTAATTTACACTT | 1-1-4-7-2-1-2 | TcTATTtaatttaCAcTT | 765_5 | -19.12 | 30677 |
| 766 | TCTATTTAATTTACACTTAA | 2-1-2-1-1-6-3-2-2 | TCtATtTaatttaCACttAA | 766_1 | -20.25 | 30675 |
| 766 | TCTATTTAATTTACACTTAA | 4-1-1-7-2-1-4 | TCTAtTaatttaCAcTTAA | 766_2 | -22.62 | 30675 |
| 766 | TCTATTTAATTTACACTTAA | 1-1-1-1-3-6-2-2-3 | TcTaTTTaatttaCActTAA | 766_3 | -20.38 | 30675 |
| 766 | TCTATTTAATTTACACTTAA | 3-1-2-7-1-1-2-1-2 | TCTaTTtaatttaCaCTTAA | 766_4 | -20.27 | 30675 |
| 766 | TCTATTTAATTTACACTTAA | 2-3-2-6-1-1-1-1-3 | TCtatTTaatttaCaCtTAA | 766_5 | -19.51 | 30675 |
| 767 | ATCTATTTAATTTACACTT | 2-1-2-7-4-1-2 | ATcTAtttaattTACAcTT | 767_1 | -21.49 | 30677 |
| 767 | ATCTATTTAATTTACACTT | 1-1-4-6-3-1-3 | AtCTATttaattTACaCTT | 767_2 | -23.18 | 30677 |
| 767 | ATCTATTTAATTTACACTT | 4-1-1-6-2-1-4 | ATCTaTttaattTAcACTT | 767_3 | -22.64 | 30677 |
| 767 | ATCTATTTAATTTACACTT | 5-7-2-2-3 | ATCTAtttaattTAcaCTT | 767_4 | -22.78 | 30677 |
| 767 | ATCTATTTAATTTACACTT | 1-1-4-6-1-1-5 | AtCTATttaattTaCACTT | 767_5 | -23.52 | 30677 |
| 768 | ATCTATTTAATTTACACTTA | 1-2-4-6-2-1-1-1-2 | AtcTATTtaatttACaCtTA | 768_1 | -21.10 | 30676 |
| 768 | ATCTATTTAATTTACACTTA | 1-1-3-1-1-6-1-1-5 | AtCTAtTtaatttAcACTTA | 768_2 | -22.17 | 30676 |
| 768 | ATCTATTTAATTTACACTTA | 3-2-2-6-1-1-2-1-2 | ATCtaTTtaatttAcACtTA | 768_3 | -20.60 | 30676 |
| 768 | ATCTATTTAATTTACACTTA | 1-1-2-1-2-7-2-2-2 | AtCTaTTtaatttaCActTA | 768_4 | -20.80 | 30676 |
| 768 | ATCTATTTAATTTACACTTA | 3-1-1-1-1-7-1-2-3 | ATCtAtTtaatttaCacTTA | 768_5 | -19.72 | 30676 |
| 769 | TATCTATTTAATTTACACTT | 1-1-2-1-2-6-4-1-2 | TaTCTATttaattTACAcTT | 769_1 | -22.65 | 30677 |
| 769 | TATCTATTTAATTTACACTT | 2-1-1-1-2-6-2-1-4 | TAtCtATttaattTAcACTT | 769_2 | -22.23 | 30677 |
| 769 | TATCTATTTAATTTACACTT | 2-1-4-6-2-3-2 | TAtCTATttaattTAcacTT | 769_3 | -22.66 | 30677 |
| 769 | TATCTATTTAATTTACACTT | 1-3-3-6-1-1-5 | TatcTATttaattTaCACTT | 769_4 | -22.96 | 30677 |
| 769 | TATCTATTTAATTTACACTT | 1-1-3-1-1-6-1-3-3 | TaTCTaTttaattTacaCTT | 769_5 | -21.15 | 30677 |
| 770 | TATCTATTTAATTTACACT | 2-1-3-6-3-1-3 | TAtCTAtttaatTTAcACT | 770_1 | -22.62 | 30678 |
| 770 | TATCTATTTAATTTACACT | 1-1-4-6-3-1-3 | TaTCTAtttaatTTAcACT | 770_2 | -22.62 | 30678 |
| 770 | TATCTATTTAATTTACACT | 2-2-2-6-2-1-4 | TAtcTAtttaatTTaCACT | 770_3 | -21.84 | 30678 |
| 770 | TATCTATTTAATTTACACT | 1-2-3-6-1-1-5 | TatCTAtttaatTtACACT | 770_4 | -21.72 | 30678 |
| 770 | TATCTATTTAATTTACACT | 4-1-1-7-2-1-3 | TATCtAtttaatttAcACT | 770_5 | -21.09 | 30678 |
| 771 | TTATCTATTTAATTTACACT | 2-4-1-6-4-1-2 | TTatctAtttaatTTACaCT | 771_1 | -20.22 | 30678 |
| 771 | TTATCTATTTAATTTACACT | 2-2-3-6-3-2-2 | TTatCTAtttaatTTAcaCT | 771_2 | -22.76 | 30678 |
| 771 | TTATCTATTTAATTTACACT | 1-1-5-6-2-2-3 | TtATCTAtttaatTTacACT | 771_3 | -22.87 | 30678 |
| 771 | TTATCTATTTAATTTACACT | 2-3-6-1-2-4 | TTatCTAtttaatTtaCACT | 771_4 | -22.94 | 30678 |
| 771 | TTATCTATTTAATTTACACT | 5-1-1-7-1-2-3 | TTATCtAtttaatttTacACT | 771_5 | -21.68 | 30678 |
| 772 | TTTATCTATTTAATTTACA | 1-1-3-7-4-1-2 | TtTATctatttaATTTaCA | 772_1 | -19.96 | 30680 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 772 | TTTATCTATTTAATTTACA | 4-1-1-6-3-2-2 | TTTAtCtatttaATTtaCA | 772_2 | -19.70 | 30680 |
| 772 | TTTATCTATTTAATTTACA | 3-1-2-6-2-1-4 | TTTaTCtatttaATtTACA | 772_3 | -21.24 | 30680 |
| 772 | TTTATCTATTTAATTTACA | 5-7-2-2-3 | TTTATctatttaATttACA | 772_4 | -19.82 | 30680 |
| 772 | TTTATCTATTTAATTTACA | 1-1-4-6-1-1-5 | TtTATCtatttaAtTTACA | 772_5 | -21.42 | 30680 |
| 773 | TTTTATCTATTTAATTTAC | 2-1-3-6-3-1-3 | TTtTATctatttAATtTAC | 773_1 | -19.10 | 30681 |
| 773 | TTTTATCTATTTAATTTAC | 1-1-4-6-2-1-4 | TtTTATctatttAAtTTAC | 773_2 | -18.66 | 30681 |
| 773 | TTTTATCTATTTAATTTAC | 3-1-2-6-1-1-5 | TTTTATctatttAaTTTAC | 773_3 | -18.15 | 30681 |
| 773 | TTTTATCTATTTAATTTAC | 1-2-3-6-1-1-5 | TttTATctatttAaTTTAC | 773_4 | -18.29 | 30681 |
| 773 | TTTTATCTATTTAATTTAC | 2-1-3-6-1-2-4 | TTtTATctatttAatTTAC | 773_5 | -18.15 | 30681 |
| 774 | TTTTATCTATTTAATTTACA | 1-1-2-1-1-7-4-1-2 | TtTTaTctatttaATTTaCA | 774_1 | -19.84 | 30680 |
| 774 | TTTTATCTATTTAATTTACA | 2-1-1-1-2-6-3-1-3 | TTtTaTCtatttaATTTACA | 774_2 | -20.79 | 30680 |
| 774 | TTTTATCTATTTAATTTACA | 4-2-1-6-2-1-4 | TTTTatCtatttaATtTACA | 774_3 | -21.94 | 30680 |
| 774 | TTTTATCTATTTAATTTACA | 1-1-5-6-2-3-2 | TtTTATCtatttaATttaCA | 774_4 | -21.32 | 30680 |
| 774 | TTTTATCTATTTAATTTACA | 2-2-3-6-1-2-4 | TTttATCtatttaAttTACA | 774_5 | -20.67 | 30680 |
| 775 | CTTTTATCTATTTAATTTA | 5-7-4-1-2 | CTTTTatctattTAAtTTA | 775_1 | -21.18 | 30682 |
| 775 | CTTTTATCTATTTAATTTA | 5-7-2-1-4 | CTTTTatctattTAaTTTA | 775_2 | -21.18 | 30682 |
| 775 | CTTTTATCTATTTAATTTA | 5-7-2-2-3 | CTTTTatctattTAatTTA | 775_3 | -20.23 | 30682 |
| 775 | CTTTTATCTATTTAATTTA | 3-1-1-7-1-1-5 | CTTtTatctattTaATTTA | 775_4 | -19.83 | 30682 |
| 775 | CTTTTATCTATTTAATTTA | 2-1-2-7-1-1-1-3 | CTtTTatctattTaAtTTA | 775_5 | -18.07 | 30682 |
| 776 | CTTTTATCTATTTAATTTAC | 1-1-5-6-4-1-2 | CtTTTATctatttAATTTAC | 776_1 | -21.25 | 30681 |
| 776 | CTTTTATCTATTTAATTTAC | 3-1-1-8-3-1-3 | CTTtTatctatttAATtTAC | 776_2 | -20.13 | 30681 |
| 776 | CTTTTATCTATTTAATTTAC | 5-8-2-1-4 | CTTTTatctatttAAtTTAC | 776_3 | -21.02 | 30681 |
| 776 | CTTTTATCTATTTAATTTAC | 1-1-2-1-2-6-2-1-4 | CtTTTATctatttAAtTTAC | 776_4 | -19.49 | 30681 |
| 776 | CTTTTATCTATTTAATTTAC | 2-1-4-6-2-2-3 | CTtTTATctatttAAttTAC | 776_5 | -21.33 | 30681 |
| 777 | ACTTTTATCTATTTAATTT | 4-1-1-6-4-1-2 | ACTTtTatctatTTAAtTT | 777_1 | -20.04 | 30683 |
| 777 | ACTTTTATCTATTTAATTT | 3-1-2-6-3-1-3 | ACTtTTatctatTTAaTTT | 777_2 | -20.48 | 30683 |
| 777 | ACTTTTATCTATTTAATTT | 5-7-2-1-4 | ACTTTtatctatTTaATTT | 777_3 | -20.54 | 30683 |
| 777 | ACTTTTATCTATTTAATTT | 2-2-2-6-2-1-4 | ACttTTatctatTTaATTT | 777_4 | -19.26 | 30683 |
| 777 | ACTTTTATCTATTTAATTT | 4-1-1-6-1-2-4 | ACTTtTatctatTtaATTT | 777_5 | -19.21 | 30683 |
| 778 | ACTTTTATCTATTTAATTTA | 2-3-1-7-4-1-2 | ACtttTatctattTAAtTTA | 778_1 | -19.89 | 30682 |
| 778 | ACTTTTATCTATTTAATTTA | 1-1-4-7-2-1-1-2 | AcTTTTatctattTaAtTTA | 778_2 | -19.82 | 30682 |
| 778 | ACTTTTATCTATTTAATTTA | 3-2-1-7-2-2-3 | ACTttTatctattTAatTTA | 778_3 | -20.13 | 30682 |
| 778 | ACTTTTATCTATTTAATTTA | 4-9-1-1-5 | ACTTtatctattTaATTTA | 778_4 | -21.14 | 30682 |
| 778 | ACTTTTATCTATTTAATTTA | 2-1-3-7-1-1-5 | ACtTTTatctattTaATTTA | 778_5 | -21.49 | 30682 |
| 779 | ACTTTTATCTATTTAATT | 2-1-3-6-2-1-3 | ACtTTTatctatTTaATT | 779_1 | -18.25 | 30684 |
| 779 | ACTTTTATCTATTTAATT | 4-1-1-7-5 | ACTTtTatctattTAATT | 779_2 | -19.17 | 30684 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 779 | ACTTTTATCTATTTAATT | 3-1-2-7-5 | ACTtTTatctattTAATT | 779_3 | −19.17 | 30684 |
| 779 | ACTTTTATCTATTTAATT | 2-1-3-7-5 | ACtTTTatctattTAATT | 779_4 | −18.79 | 30684 |
| 779 | ACTTTTATCTATTTAATT | 1-1-4-7-5 | AcTTTTatctattTAATT | 779_5 | −18.42 | 30684 |
| 780 | AACTTTTATCTATTTAATT | 5-7-3-1-3 | AACTTttatctaTTTaATT | 780_1 | −19.61 | 30684 |
| 780 | AACTTTTATCTATTTAATT | 5-8-3-1-2 | AACTTttatctatTTAaTT | 780_2 | −18.68 | 30684 |
| 780 | AACTTTTATCTATTTAATT | 4-1-1-7-3-1-2 | AACTtTatctatTTAaTT | 780_3 | −18.17 | 30684 |
| 780 | AACTTTTATCTATTTAATT | 1-1-4-7-2-1-3 | AaCTTTtatctatTTAaTT | 780_4 | −18.45 | 30684 |
| 780 | AACTTTTATCTATTTAATT | 5-9-5 | AACTTttatctattTAATT | 780_5 | −19.19 | 30684 |
| 781 | AACTTTTATCTATTTAAT | 5-8-5 | AACTTttatctatTTAAT | 781_1 | −18.18 | 30685 |
| 782 | AACTTTTATCTATTTAATTT | 1-1-1-1-3-6-4-1-2 | AaCtTTTatctatTTAAtTT | 782_1 | −19.40 | 30683 |
| 782 | AACTTTTATCTATTTAATTT | 4-2-1-6-3-1-3 | AACTttTatctatTTAaTTT | 782_2 | −20.41 | 30683 |
| 782 | AACTTTTATCTATTTAATTT | 5-1-1-6-2-1-4 | AACTTtTatctatTTaATTT | 782_3 | −21.20 | 30683 |
| 782 | AACTTTTATCTATTTAATTT | 2-1-4-6-1-2-4 | AAcTTTTatctatTtaATTT | 782_4 | −19.21 | 30683 |
| 782 | AACTTTTATCTATTTAATTT | 1-1-2-1-2-7-2-1-3 | AaCtTTTatctattTAaTTT | 782_5 | −19.40 | 30683 |
| 783 | TAACTTTTATCTATTTAAT | 2-1-3-6-4-1-2 | TAaCTTttatctATTTaAT | 783_1 | −19.91 | 30685 |
| 783 | TAACTTTTATCTATTTAAT | 2-1-3-6-2-1-4 | TAaCTTttatctATtTAAT | 783_2 | −19.93 | 30685 |
| 783 | TAACTTTTATCTATTTAAT | 5-7-2-1-1-1-2 | TAACTttatctATtTaAT | 783_3 | −18.79 | 30685 |
| 783 | TAACTTTTATCTATTTAAT | 1-1-4-6-1-1-5 | TaACTTTtatctAtTTAAT | 783_4 | −19.16 | 30685 |
| 783 | TAACTTTTATCTATTTAAT | 5-9-5 | TAACTttatctatTTAAT | 783_5 | −19.60 | 30685 |
| 784 | TAACTTTTATCTATTTAATT | 4-1-1-7-1-1-2-1-2 | TAACtTttatctaTtTaATT | 784_1 | −18.83 | 30684 |
| 784 | TAACTTTTATCTATTTAATT | 2-1-4-7-3-1-2 | TAaCTTTtatctatTTAaTT | 784_2 | −20.71 | 30684 |
| 784 | TAACTTTTATCTATTTAATT | 2-1-3-8-2-1-3 | TAaCTTttatctatTTAaTT | 784_3 | −19.87 | 30684 |
| 784 | TAACTTTTATCTATTTAATT | 1-1-5-7-2-1-3 | TaACTTTtatctatTTAaTT | 784_4 | −20.35 | 30684 |
| 784 | TAACTTTTATCTATTTAATT | 5-10-5 | TAACTttatctattTAATT | 784_5 | −20.61 | 30684 |
| 785 | TAACTTTTATCTATTTAA | 5-7-2-1-3 | TAACTtttatctATtTAA | 785_1 | −18.07 | 30686 |
| 786 | ATAACTTTTATCTATTTAA | 3-1-2-6-4-1-2 | ATAaCTtttatcTATTtAA | 786_1 | −20.14 | 30686 |
| 786 | ATAACTTTTATCTATTTAA | 4-1-1-6-3-1-3 | ATAAcTtttatcTATtTAA | 786_2 | −20.03 | 30686 |
| 786 | ATAACTTTTATCTATTTAA | 2-1-3-6-2-1-4 | ATaACTtttatcTAtTTAA | 786_3 | −20.33 | 30686 |
| 786 | ATAACTTTTATCTATTTAA | 3-1-2-6-2-2-3 | ATAaCTtttatcTAttTAA | 786_4 | −19.84 | 30686 |
| 786 | ATAACTTTTATCTATTTAA | 5-7-1-1-5 | ATAACtttatcTaTTTAA | 786_5 | −20.30 | 30686 |
| 787 | ATAACTTTTATCTATTTAAT | 3-1-3-6-3-2-2 | ATAaCTTtttatctATTtaAT | 787_1 | −20.73 | 30685 |
| 787 | ATAACTTTTATCTATTTAAT | 2-1-4-6-2-1-4 | ATaACTTtttatctATtTAAT | 787_2 | −21.66 | 30685 |
| 787 | ATAACTTTTATCTATTTAAT | 3-1-2-7-1-2-4 | ATAaCTtttatctAttTAAT | 787_3 | −19.93 | 30685 |
| 787 | ATAACTTTTATCTATTTAAT | 4-2-1-7-3-1-2 | ATAActTttatctaTTTaAT | 787_4 | −18.98 | 30685 |
| 787 | ATAACTTTTATCTATTTAAT | 2-1-4-8-5 | ATaACTTtttatctatTTAAT | 787_5 | −21.13 | 30685 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 788 | TATAACTTTTATCTATTTA | 1-1-2-1-1-6-4-1-2 | TaTAaCttttatCTAtTTA | 788_1 | −21.10 | 30687 |
| 788 | TATAACTTTTATCTATTTA | 2-2-2-6-3-1-3 | TAtaACttttatCTAtTTA | 788_2 | −20.60 | 30687 |
| 788 | TATAACTTTTATCTATTTA | 3-1-2-6-2-1-4 | TATAACttttatCTaTTTA | 788_3 | −22.09 | 30687 |
| 788 | TATAACTTTTATCTATTTA | 5-7-1-1-5 | TATAActtttatCtATTTA | 788_4 | −21.33 | 30687 |
| 788 | TATAACTTTTATCTATTTA | 4-1-1-7-2-2-2 | TATAaCttttatcTAttTA | 788_5 | −20.13 | 30687 |
| 789 | TATAACTTTTATCTATTTAA | 4-1-1-7-4-1-2 | TATAaCttttatcTATTTAA | 789_1 | −21.18 | 30686 |
| 789 | TATAACTTTTATCTATTTAA | 2-2-3-6-3-1-3 | TAtaACTtttatcTATtTAA | 789_2 | −21.32 | 30686 |
| 789 | TATAACTTTTATCTATTTAA | 1-1-5-6-2-1-4 | TaTAACTtttatcTAtTTAA | 789_3 | −21.97 | 30686 |
| 789 | TATAACTTTTATCTATTTAA | 3-1-2-7-1-1-1-3 | TATAaCttttatcTaTtTAA | 789_4 | −19.86 | 30686 |
| 789 | TATAACTTTTATCTATTTAA | 4-2-1-6-1-2-4 | TATAacTtttatcTatTTAA | 789_5 | −20.09 | 30686 |
| 790 | TTATAACTTTTATCTATTT | 2-1-3-6-4-1-2 | TTaTAActtttaTCTAtTT | 790_1 | −21.00 | 30688 |
| 790 | TTATAACTTTTATCTATTT | 5-7-2-2-3 | TTATAactttaTCtaTTT | 790_2 | −20.52 | 30688 |
| 790 | TTATAACTTTTATCTATTT | 4-1-1-6-1-1-5 | TTATaActtttaTcTATTT | 790_3 | −21.08 | 30688 |
| 790 | TTATAACTTTTATCTATTT | 4-1-1-7-3-1-2 | TTATaActtttatCTAtTT | 790_4 | −20.46 | 30688 |
| 790 | TTATAACTTTTATCTATTT | 2-1-3-8-5 | TTaTAActtttatcTATTT | 790_5 | −19.98 | 30688 |
| 791 | TTATAACTTTTATCTATT | 5-7-3-1-2 | TTATAactttaTCTaTT | 791_1 | −20.32 | 30689 |
| 791 | TTATAACTTTTATCTATT | 5-7-1-1-4 | TTATAactttaTcTATT | 791_2 | −19.99 | 30689 |
| 791 | TTATAACTTTTATCTATT | 4-1-1-7-5 | TTATaActtttatCTATT | 791_3 | −20.40 | 30689 |
| 791 | TTATAACTTTTATCTATT | 4-9-5 | TTATaacttttatCTATT | 791_4 | −19.98 | 30689 |
| 791 | TTATAACTTTTATCTATT | 2-1-3-7-5 | TTaTAActtttatCTATT | 791_5 | −19.81 | 30689 |
| 792 | TTATAACTTTTATCTATTTA | 1-2-1-1-2-6-3-2-2 | TtaTaACttttatCTAttTA | 792_1 | −20.10 | 30687 |
| 792 | TTATAACTTTTATCTATTTA | 3-2-1-7-1-1-2-1-2 | TTAtaActtttatCtATtTA | 792_2 | −18.80 | 30687 |
| 792 | TTATAACTTTTATCTATTTA | 4-1-2-6-1-3-3 | TTATaACttttatCtatTTA | 792_3 | −21.34 | 30687 |
| 792 | TTATAACTTTTATCTATTTA | 2-1-2-1-1-7-2-1-3 | TTaTAaCttttatcTAtTTA | 792_4 | −20.83 | 30687 |
| 792 | TTATAACTTTTATCTATTTA | 1-1-4-8-1-1-4 | TtATAActtttatcTaTTTA | 792_5 | −19.94 | 30687 |
| 793 | CTTATAACTTTTATCTATT | 1-1-1-1-2-6-3-2-2 | CtTaTAacttttATCtaTT | 793_1 | −19.45 | 30689 |
| 793 | CTTATAACTTTTATCTATT | 1-2-3-6-1-1-5 | CttATAacttttAtCTATT | 793_2 | −21.25 | 30689 |
| 793 | CTTATAACTTTTATCTATT | 3-2-1-8-5 | CTTatAacttttatCTATT | 793_3 | −20.78 | 30689 |
| 793 | CTTATAACTTTTATCTATT | 1-1-3-9-2-1-2 | CtTAtaacttttatCTaTT | 793_4 | −19.82 | 30689 |
| 793 | CTTATAACTTTTATCTATT | 5-9-1-1-3 | CTTATaacttttatCtATT | 793_5 | −20.81 | 30689 |
| 794 | CTTATAACTTTTATCTAT | 5-7-3-1-2 | CTTATaactttttATCtAT | 794_1 | −21.02 | 30690 |
| 794 | CTTATAACTTTTATCTAT | 1-1-3-7-1-1-4 | CtTATaacttttAtCTAT | 794_2 | −20.04 | 30690 |
| 794 | CTTATAACTTTTATCTAT | 2-2-1-8-5 | CTtaTaacttttaTCTAT | 794_3 | −19.59 | 30690 |
| 794 | CTTATAACTTTTATCTAT | 3-1-2-8-4 | CTTaTAacttttatCTAT | 794_4 | −20.86 | 30690 |
| 794 | CTTATAACTTTTATCTAT | 5-10-3 | CTTATaacttttatcTAT | 794_5 | −19.99 | 30690 |
| 795 | CTTATAACTTTTATCTATTT | 1-1-1-2-2-6-2-1-1-2 | CtTatAActtttaTCtAtTT | 795_1 | −18.22 | 30688 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 795 | CTTATAACTTTTATCTATTT | 1-1-1-1-2-8-2-1-3 | CtTaTAactttatCTaTTT | 795_2 | -20.86 | 30688 |
| 795 | CTTATAACTTTTATCTATTT | 2-1-2-1-1-7-2-2-2 | CTtATaActtttatCTatTT | 795_3 | -20.54 | 30688 |
| 795 | CTTATAACTTTTATCTATTT | 3-2-1-8-1-1-1-1-2 | CTTatAactttatCtAtTT | 795_4 | -18.19 | 30688 |
| 795 | CTTATAACTTTTATCTATTT | 1-2-2-1-1-9-4 | CttATaActtttatctATTT | 795_5 | -18.61 | 30688 |
| 796 | CTTATAACTTTTATCTA | 5-6-2-1-3 | CTTATaactttTAtCTA | 796_1 | -21.44 | 30691 |
| 796 | CTTATAACTTTTATCTA | 5-6-1-2-3 | CTTATaactttTatCTA | 796_2 | -20.31 | 30691 |
| 796 | CTTATAACTTTTATCTA | 1-1-3-7-5 | CtTATaactttATCTA | 796_3 | -19.90 | 30691 |
| 796 | CTTATAACTTTTATCTA | 3-1-1-8-4 | CTTaTaacttttaTCTA | 796_4 | -18.77 | 30691 |
| 796 | CTTATAACTTTTATCTA | 2-1-2-8-4 | CTtATaacttttaTCTA | 796_5 | -18.43 | 30691 |
| 797 | GCTTATAACTTTTATCTA | 2-2-2-6-2-2-2 | GCttATaacttttTAtcTA | 797_1 | -21.32 | 30691 |
| 797 | GCTTATAACTTTTATCTA | 4-9-1-1-3 | GCTTataacttttAtCTA | 797_2 | -21.88 | 30691 |
| 797 | GCTTATAACTTTTATCTA | 2-12-4 | GCttataacttttaTCTA | 797_3 | -20.47 | 30691 |
| 797 | GCTTATAACTTTTATCTA | 2-1-1-1-1-9-3 | GCtTaTaacttttatCTA | 797_4 | -20.94 | 30691 |
| 797 | GCTTATAACTTTTATCTA | 1-1-4-10-2 | GcTTATaacttttatcTA | 797_5 | -19.62 | 30691 |
| 798 | GCTTATAACTTTTATCT | 2-9-1-2-3 | GCttataactttTtaTCT | 798_1 | -18.54 | 30692 |
| 798 | GCTTATAACTTTTATCT | 2-10-5 | GCttataactttTATCT | 798_2 | -20.90 | 30692 |
| 798 | GCTTATAACTTTTATCT | 4-8-1-1-3 | GCTTataactttTaTCT | 798_3 | -21.40 | 30692 |
| 798 | GCTTATAACTTTTATCT | 2-1-2-8-4 | GCtTAtaacttttATCT | 798_4 | -21.00 | 30692 |
| 798 | GCTTATAACTTTTATCT | 5-10-2 | GCTTAtaacttttatCT | 798_5 | -20.68 | 30692 |
| 799 | TGCTTATAACTTTTATC | 3-8-3-1-2 | TGCttataaactTTTaTC | 799_1 | -19.59 | 30693 |
| 799 | TGCTTATAACTTTTATC | 3-8-2-1-3 | TGCttataaactTTTATC | 799_2 | -19.26 | 30693 |
| 799 | TGCTTATAACTTTTATC | 2-10-5 | TGcttataaacttTTATC | 799_3 | -18.08 | 30693 |
| 799 | TGCTTATAACTTTTATC | 5-8-4 | TGCTTataaactttTATC | 799_4 | -22.34 | 30693 |
| 799 | TGCTTATAACTTTTATC | 3-10-4 | TGCttataaacttttTATC | 799_5 | -19.90 | 30693 |
| 800 | TGCTTATAACTTTTATCT | 3-9-3-1-2 | TGCttataacttTTAtCT | 800_1 | -22.27 | 30692 |
| 800 | TGCTTATAACTTTTATCT | 2-2-2-7-5 | TGctTAtaactttTATCT | 800_2 | -22.61 | 30692 |
| 800 | TGCTTATAACTTTTATCT | 3-10-1-1-3 | TGCttataacttttTaTCT | 800_3 | -21.45 | 30692 |
| 800 | TGCTTATAACTTTTATCT | 1-1-1-1-2-8-4 | TgCtTAtaacttttATCT | 800_4 | -20.79 | 30692 |
| 800 | TGCTTATAACTTTTATCT | 4-1-1-10-2 | TGCTtAtaactttatCT | 800_5 | -20.89 | 30692 |
| 801 | CTGCTTATAACTTTTATC | 2-1-1-8-2-1-3 | CTgCttataactTTtATC | 801_1 | -20.05 | 30693 |
| 801 | CTGCTTATAACTTTTATC | 4-8-1-3-2 | CTGCttataactTttaTC | 801_2 | -21.02 | 30693 |
| 801 | CTGCTTATAACTTTTATC | 2-1-1-10-4 | CTgCttataactttTATC | 801_3 | -20.69 | 30693 |
| 801 | CTGCTTATAACTTTTATC | 1-1-2-10-1-1-2 | CtGCttataacttttTaTC | 801_4 | -18.86 | 30693 |
| 801 | CTGCTTATAACTTTTATC | 1-1-4-9-3 | CtGCTTataactttttATC | 801_5 | -21.47 | 30693 |
| 802 | CTCTGCTTATAACTTTT | 1-1-1-1-1-6-2-1-3 | CtCtGcttataACtTTT | 802_1 | -18.92 | 30696 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 802 | CTCTGCTTATAACTTTT | 1-1-1-1-1-7-2-1-2 | CtCtGcttataaCTtTT | 802_2 | −18.47 | 30696 |
| 802 | CTCTGCTTATAACTTTT | 1-1-2-8-1-1-3 | CtCTgcttataaCtTTT | 802_3 | −19.44 | 30696 |
| 802 | CTCTGCTTATAACTTTT | 1-2-2-7-1-1-3 | CtcTGcttataaCtTTT | 802_4 | −19.02 | 30696 |
| 802 | CTCTGCTTATAACTTTT | 3-1-1-10-2 | CTCtGcttataacttTT | 802_5 | −18.16 | 30696 |
| 803 | CCTCTGCTTATAACTTT | 1-1-2-7-2-1-3 | CcTCtgcttatAAcTTT | 803_1 | −20.60 | 30697 |
| 803 | CCTCTGCTTATAACTTT | 2-9-1-3-2 | CCtctgcttatAactTT | 803_2 | −19.28 | 30697 |
| 803 | CCTCTGCTTATAACTTT | 2-2-1-7-1-2-2 | CCtcTgcttataActTT | 803_3 | −20.58 | 30697 |
| 803 | CCTCTGCTTATAACTTT | 1-2-1-8-1-2-2 | CctCtgcttataActTT | 803_4 | −18.06 | 30697 |
| 803 | CCTCTGCTTATAACTTT | 2-1-1-9-1-1-2 | CCtCtgcttataaCtTT | 803_5 | −21.12 | 30697 |
| 804 | CTACTATACTTTCCTCT | 3-8-2-2-2 | CTActatactttTCctCT | 804_1 | −22.54 | 30709 |
| 804 | CTACTATACTTTCCTCT | 1-1-1-9-2-1-2 | CtActatactttCCtCT | 804_2 | −21.39 | 30709 |
| 804 | CTACTATACTTTCCTCT | 1-2-1-8-1-2-2 | CtaCtatactttCctCT | 804_3 | −19.70 | 30709 |
| 804 | CTACTATACTTTCCTCT | 2-11-1-1-2 | CTactatacttcCtCT | 804_4 | −20.45 | 30709 |
| 804 | CTACTATACTTTCCTCT | 1-3-1-8-1-1-2 | CtacTatactttcCtCT | 804_5 | −19.77 | 30709 |
| 805 | TCTACTATACTTTCCTCT | 2-1-1-9-1-2-2 | TCtActatactttCctCT | 805_1 | −21.40 | 30709 |
| 805 | TCTACTATACTTTCCTCT | 2-2-1-8-1-2-2 | TCtaCtatactttCctCT | 805_2 | −22.20 | 30709 |
| 805 | TCTACTATACTTTCCTCT | 2-11-1-2-2 | TCtactatactttCctCT | 805_3 | −21.20 | 30709 |
| 805 | TCTACTATACTTTCCTCT | 2-1-1-10-1-1-2 | TCtActatactttcCtCT | 805_4 | −21.52 | 30709 |
| 805 | TCTACTATACTTTCCTCT | 2-2-1-9-1-1-2 | TCtaCtatactttcCtCT | 805_5 | −22.32 | 30709 |
| 806 | TTCTACTATACTTTCCT | 1-1-1-8-1-3-2 | TtCtactatacTttcCT | 806_1 | −18.06 | 30711 |
| 806 | TTCTACTATACTTTCCT | 1-2-1-7-1-3-2 | TtcTactatacTttcCT | 806_2 | −18.02 | 30711 |
| 806 | TTCTACTATACTTTCCT | 1-1-1-1-1-7-1-1-3 | TtCtActatactTtCCT | 806_3 | −20.41 | 30711 |
| 806 | TTCTACTATACTTTCCT | 1-1-1-10-4 | TtCtactatacttTCCT | 806_4 | −20.90 | 30711 |
| 806 | TTCTACTATACTTTCCT | 1-1-1-1-9-3 | TtCtActatactttCCT | 806_5 | −20.11 | 30711 |
| 807 | TTCTACTATACTTTCCTC | 1-2-1-8-1-1-1-2 | TtcTactatactTtCcTC | 807_1 | −19.51 | 30710 |
| 807 | TTCTACTATACTTTCCTC | 1-1-1-2-1-6-1-3-2 | TtCtaCtatactTtccTC | 807_2 | −19.77 | 30710 |
| 807 | TTCTACTATACTTTCCTC | 1-1-1-1-1-9-1-1-2 | TtCtActatactttCcTC | 807_3 | −19.44 | 30710 |
| 807 | TTCTACTATACTTTCCTC | 1-1-1-12-3 | TtCtactatactttcCTC | 807_4 | −20.04 | 30710 |
| 807 | TTCTACTATACTTTCCTC | 1-2-1-1-1-10-2 | TtcTaCtatactttccTC | 807_5 | −19.43 | 30710 |
| 808 | TTTCCATCTACTATTAAT | 1-1-3-7-3-1-2 | TtTCCatctactATTaAT | 808_1 | −21.43 | 39804 |
| 808 | TTTCCATCTACTATTAAT | 2-1-2-7-1-1-1-2 | TTtCCatctactAtTaAT | 808_2 | −19.50 | 39804 |
| 808 | TTTCCATCTACTATTAAT | 1-1-4-6-1-2-3 | TtTCCAtctactAttAAT | 808_3 | −20.72 | 39804 |
| 808 | TTTCCATCTACTATTAAT | 2-1-2-8-1-1-3 | TTtCCatctactaTtAAT | 808_4 | −19.43 | 39804 |
| 808 | TTTCCATCTACTATTAAT | 4-1-1-8-4 | TTTCcAtctactatTAAT | 808_5 | −20.12 | 39804 |
| 809 | TTTCCATCTACTATTAA | 5-6-3-1-2 | TTTCCatctacTATtAA | 809_1 | −21.74 | 39805 |
| 809 | TTTCCATCTACTATTAA | 2-1-2-6-2-1-3 | TTtCCatctacTAtTAA | 809_2 | −20.76 | 39805 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 809 | TTTCCATCTACTATTAA | 1-1-3-6-1-1-4 | TtTCCatctacTaTTAA | 809_3 | −20.75 | 39805 |
| 809 | TTTCCATCTACTATTAA | 2-1-2-7-5 | TTtCCatctactATTAA | 809_4 | −20.54 | 39805 |
| 809 | TTTCCATCTACTATTAA | 5-9-3 | TTTCCatctactatTAA | 809_5 | −20.18 | 39805 |
| 810 | GTTTCCATCTACTATTA | 3-9-2-1-2 | GTTtccatctacTAtTA | 810_1 | −20.81 | 39806 |
| 810 | GTTTCCATCTACTATTA | 1-1-1-1-1-7-1-1-3 | GtTtCcatctacTaTTA | 810_2 | −19.35 | 39806 |
| 810 | GTTTCCATCTACTATTA | 2-2-1-7-1-2-2 | GTttCcatctacTatTA | 810_3 | −19.64 | 39806 |
| 810 | GTTTCCATCTACTATTA | 3-1-1-8-4 | GTTtCcatctactATTA | 810_4 | −21.37 | 39806 |
| 810 | GTTTCCATCTACTATTA | 1-2-2-10-2 | GttTCcatctactatTA | 810_5 | −18.14 | 39806 |
| 811 | AATACAAAATCATCTTAC | 3-1-2-6-1-1-4 | AATaCAaaatcaTcTTAC | 811_1 | −18.05 | 39836 |
| 811 | AATACAAAATCATCTTAC | 4-9-5 | AATAcaaaatcatCTTAC | 811_2 | −18.25 | 39836 |
| 811 | AATACAAAATCATCTTAC | 3-1-2-7-5 | AATaCAaaatcatCTTAC | 811_3 | −19.20 | 39836 |
| 811 | AATACAAAATCATCTTAC | 2-1-3-7-5 | AAtACAaaatcatCTTAC | 811_4 | −18.12 | 39836 |
| 811 | AATACAAAATCATCTTAC | 1-1-4-7-5 | AaTACAaaatcatCTTAC | 811_5 | −19.50 | 39836 |
| 812 | AATACAAAATCATCTTACA | 2-2-2-6-4-1-2 | AAtaCAaaatcaTCTTaCA | 812_1 | −20.31 | 39835 |
| 812 | AATACAAAATCATCTTACA | 4-8-3-2-2 | AATAcaaaatcaTCTtaCA | 812_2 | −19.80 | 39835 |
| 812 | AATACAAAATCATCTTACA | 3-1-2-6-2-1-4 | AATaCAaaatcaTCtTACA | 812_3 | −21.91 | 39835 |
| 812 | AATACAAAATCATCTTACA | 1-1-4-7-2-2-2 | AaTACAaaatcatCTtaCA | 812_4 | −19.93 | 39835 |
| 812 | AATACAAAATCATCTTACA | 5-8-1-1-4 | AATACaaaatcatCtTACA | 812_5 | −20.93 | 39835 |
| 813 | TAATACAAAATCATCTTA | 1-1-4-6-3-1-2 | TaATACaaaatcATCtTA | 813_1 | −18.46 | 39837 |
| 813 | TAATACAAAATCATCTTA | 5-8-5 | TAATAcaaaatcaTCTTA | 813_2 | −19.57 | 39837 |
| 813 | TAATACAAAATCATCTTA | 5-9-4 | TAATAcaaaatcatCTTA | 813_3 | −18.44 | 39837 |
| 813 | TAATACAAAATCATCTTA | 2-1-3-8-4 | TAaTACaaaatcatCTTA | 813_4 | −18.20 | 39837 |
| 813 | TAATACAAAATCATCTTA | 1-1-4-8-4 | TaATACaaaatcatCTTA | 813_5 | −18.18 | 39837 |
| 814 | TAATACAAAATCATCTTAC | 2-1-3-6-4-1-2 | TAaTACaaaatcATCTtAC | 814_1 | −19.95 | 39836 |
| 814 | TAATACAAAATCATCTTAC | 4-1-1-6-3-1-3 | TAATaCaaaatcATCtTAC | 814_2 | −20.22 | 39836 |
| 814 | TAATACAAAATCATCTTAC | 1-2-3-6-1-1-5 | TaaTACaaaatcAtCTTAC | 814_3 | −19.14 | 39836 |
| 814 | TAATACAAAATCATCTTAC | 5-8-2-1-3 | TAATAcaaaatcaTCtTAC | 814_4 | −19.90 | 39836 |
| 814 | TAATACAAAATCATCTTAC | 4-1-1-8-5 | TAATaCaaaatcatCTTAC | 814_5 | −19.94 | 39836 |
| 815 | TAATACAAAATCATCTTACA | 3-2-2-6-2-1-1-1-2 | TAAtaCAaaatcaTCtTaCA | 815_1 | −20.84 | 39835 |
| 815 | TAATACAAAATCATCTTACA | 2-3-1-8-2-1-3 | TAataCaaaatcatCTtACA | 815_2 | −18.77 | 39835 |
| 815 | TAATACAAAATCATCTTACA | 2-1-2-1-1-7-2-2-2 | TAaTAcAaaatcatCTtaCA | 815_3 | −19.66 | 39835 |
| 815 | TAATACAAAATCATCTTACA | 1-1-1-1-2-8-1-1-4 | TaAtACaaaatcatCtTACA | 815_4 | −19.11 | 39835 |
| 815 | TAATACAAAATCATCTTACA | 4-10-1-1-1-2 | TAATacaaaatcatCtTaCA | 815_5 | −19.22 | 39835 |
| 816 | TCTGTATACACCATCCCA | 2-10-1-1-1-2 | TCtgtatacaccAtCcCA | 816_1 | −24.49 | 46389 |
| 816 | TCTGTATACACCATCCCA | 2-3-1-6-1-3-2 | TCtgtAtacaccAtccCA | 816_2 | −23.81 | 46389 |

TABLE 3-continued

List of oligonucleotides or contiguous nucleobase sequences complementary to SEQ ID NO: 1 (motif sequences indicated by SEQ ID NO), oligonucleotide designs made from these, as well as specific oligonucleotide compounds (indicated by CMP ID NO) designed based on the motif sequence.

| Seq ID NO | Motif | Design | Compound | CMP ID NO | ΔG° | Start SEQ ID NO 1 |
|---|---|---|---|---|---|---|
| 816 | TCTGTATACACCATCCCA | 2-10-1-3-2 | TCtgtatacaccAtccCA | 816_3 | -23.72 | 46389 |
| 816 | TCTGTATACACCATCCCA | 2-1-1-10-1-1-2 | TCtGtatacaccatCcCA | 816_4 | -24.75 | 46389 |
| 816 | TCTGTATACACCATCCCA | 2-3-1-8-1-1-2 | TCtgtAtacaccatCcCA | 816_5 | -24.53 | 46389 |
| 816 | TCTGTATACACCATCCCA | 2-3-1-10-2 | TCtgtAtacaccatccCA | 816_6 | -23.76 | 46389 |
| 817 | TTCTGACTCCCTATCCA | 1-1-1-12-2 | TtCtgactccctatcCA | 817_1 | -22.56 | 46417 |
| 818 | TTTCTGACTCCCTATCC | 1-2-1-11-2 | TttCtgactccctatCC | 818_1 | -22.64 | 46418 |

Designs refer to the gapmer design, F-G-F', where each number represents the number of consecutive modified nucleosides, e.g 2' modified nucleosides (first number=5' flank), followed by the number of DNA nucleosides (second number=gap region), followed by the number of modified nucleosides, e.g 2' modified nucleosides (third number=3' flank), optionally preceded by or followed by further repeated regions of DNA and LNA, which are not necessarily part of the contiguous sequence that is complementary to the target nucleic acid. For some oligonucleotides in table 3 the flanks are mixed flanks, such flanks start and end with a 2' modified nucleosides, in these cases the gap region is the number above 5 not located at the 5' or 3' terminal in of the design.

For the oligonucleotide compounds capital letters represent beta-D-oxy LNA nucleosides, lowercase letters represent DNA nucleosides, all LNA C are 5-methyl cytosine, and 5-methyl DNA cytosines are presented by "e", all internucleoside linkages are phosphorothioate internucleoside linkages.

Oligonucleotides with an EX-EX indication as Start on SEQ ID NO: 1 are exon-exon spanning oligonucleotides designed to be complementary across exon-exon junctions of SNHG14-023 (ENST00000554726). The oligonucleotides primarily span exon2 and exon3 (i.e. are complementary to a region in exon2 and a region in exon 3)

Oligonucleotide Synthesis

Oligonucleotide synthesis is generally known in the art. Below is a protocol which may be applied. The oligonucleotides of the present invention may have been produced by slightly varying methods in terms of apparatus, support and concentrations used.

Oligonucleotides are synthesized on uridine universal supports using the phosphoramidite approach on a Mer-Made12 or an Oligomaker DNA/RNA synthesizer at 1-4 μmol scale. At the end of the synthesis, the oligonucleotides are cleaved from the solid support using aqueous ammonia for 5-16 hours at 60° C. The oligonucleotides are purified by reverse phase HPLC (RP-HPLC) or by solid phase extractions and characterized by UPLC, and the molecular mass is further confirmed by ESI-MS.

Elongation of the Oligonucleotide:

The coupling of β-cyanoethyl-phosphoramidites (DNA-A(Bz), DNA-G(ibu), DNA-C(Bz), DNA-T, LNA-5-methyl-C(Bz), LNA-A(Bz), LNA-G(dmf), LNA-T or amino-C6 linker) is performed by using a solution of 0.1 M of the 5'-O-DMT-protected amidite in acetonitrile and DCI (4,5-dicyanoimidazole) in acetonitrile (0.25 M) as activator. For the final cycle a phosphoramidite with desired modifications can be used, e.g. a C6 linker for attaching a conjugate group or a conjugate group as such. Thiolation for introduction of phosphorthioate linkages is carried out by using xanthane hydride (0.01 M in acetonitrile/pyridine 9:1). Phosphordiester linkages can be introduced using 0.02 M iodine in THF/Pyridine/water 7:2:1. The rest of the reagents are the ones typically used for oligonucleotide synthesis.

Purification by RP-HPLC:

The crude compounds are purified by preparative RP-HPLC on a Phenomenex Jupiter C18 10μ 150×10 mm column. 0.1 M ammonium acetate pH 8 and acetonitrile is used as buffers at a flow rate of 5 mL/min. The collected fractions are lyophilized to give the purified compound typically as a white solid.

Abbreviations

DCI: 4,5-Dicyanoimidazole

DCM: Dichloromethane

DMF: Dimethylformamide

DMT: 4,4'-Dimethoxytrityl

THF: Tetrahydrofurane

Bz: Benzoyl

Ibu: Isobutyryl

RP-HPLC: Reverse phase high performance liquid chromatography $T_m$ Assay

Oligonucleotide and RNA target duplexes are diluted to 3 mM in 500 ml RNase-free water and mixed with 500 ml 2×$T_m$-buffer (200 mM NaCl, 0.2 mM EDTA, 20 mM Naphosphate, pH 7.0). The solution is heated to 95° C. for 3 min and then allowed to anneal in room temperature for 30 min. The duplex melting temperatures ($T_m$) is measured on a Lambda 40 UV/VIS Spectrophotometer equipped with a Peltier temperature programmer PTP6 using PE Templab software (Perkin Elmer). The temperature is ramped up from 20° C. to 95° C. and then down to 25° C., recording absorption at 260 nm. First derivative and the local maximums of both the melting and annealing are used to assess the duplex $T_m$.

Preparation of Mouse Primary Cortical Neuron Cell Cultures

Primary cortical neuron cultures were prepared from mouse embryo brains of 15 days of age according to standard procedure. In brief, culture plates were coated with Poly-L-Lysine (50 µg/ml Poly-L-Lysine, 10 mM Na-tetraborate, pH 8 buffer) for 2-3 hrs at room temperature. The plates were washed with 1×PBS before use. Harvested mouse embryo brains were dissected and homogenized by a razor blade and submerged into 38 ml dissection medium (HBSS, 0.01 M Hepes, Penicillin/Streptomycin). Then, 2 ml trypsin was added and cells were incubated for 30 min at 37° C. and centrifuged down. The cells were dissolved in 20 ml DMEM (+10% FBS) and passed through a syringe for further homogenization. This was followed by centrifugation at 500 rpm for 15 mins. The cells were dissolved in DMEM (+10% FBS) and seeded in 96 well plates (0.1×10^6 cells/well in 100 µl). The neuronal cell cultures were ready for use directly after seeding.

Screening Oligonucleotides in Mouse Primary Cortical Neuron Cell Cultures

Cells were cultured in growth medium (Gibco Neurobasal medium, B27 supplement, Glutamax, Pencillin-streptomycin) in 96-well plates and incubated with oligonucleotides for 3 days at the desired concentrations. Total RNA was isolated from the cells and the knock-down efficacy was measured by qPCR analysis using the qScript™ XLT One-Step RT-qPCR ToughMix®, Low ROX™ kit from Quanta Bioscience (95134-500). A commercial taqman assays from Thermo Fisher Scientific was used to measure Ube3a_ATS including GAPDH for normalization.

Generation of Human Primary Neuronal Cell Cultures

Any cell lines at any described time point was incubated at 37° C., 5% CO2 concentration and 95% relative humidity.

Human Induced Pluripotent Stem Cells (hiPSC) Culture

Whole human blood samples were obtained from patients diagnosed with Angelman syndrome. The subsequent cultures of primary Peripheral Blood Mononuclear Cells (PMCSs) were enriched for erythroblasts. Patient-specific iPSC lines were generated by reprogramming erythroblast with CytoTune-iPS Sendai Reprogramming Kit (Thermo Fisher Scientific). Derived iPSC lines were maintained in feeder-free conditions using hESC-qualified Matrigel (Corning) in mTESR1 (STEMCELL Technologies) with daily medium replacement. Upon reaching confluence, colonies were dissociated into cell cluster of 50-200 µm in size using Gentle Cell Dissociation Reagent (STEMCELL Technologies) and subcultured at a ratio of 1:10-1:20 in the presence of 10 µM Y-27632 (Calbiochem).

Differentiation into Neural Progenitor Cells (NPC)

Upon induction of neural differentiation iPSC-derived cells were maintained in basal medium composed of equal volumes of DMEM:F12 Glutamax medium and Neurobasal medium (Gibco, Invitrogen), supplemented with 1×B27 (Gibco, Invitrogen), 1×N2 (Gibco, Invitrogen), 0.1 mM beta-mercaptoethanol (Gibco, Invitrogen) and indicated supplements.

Neural progenitor cells (NPCs) were derived from hiPSCs by dual SMAD inhibition and according to published procedures with slight modifications (Chambers et al. 2009 Nat Biotechnol. Vol. 3 pp. 275-80, Boissart et al., 2013 Transl Psychiatry. 3:e294). HiPSCs were dissociated with Accutase (Innovative Cell Technologies Inc.) into a single cell suspension and resuspended in basic medium further supplemented with 10 µM Y-27632 (Calbiochem), 5 ng/ml FGF (Peprotech), 10 µM SB-431542 (Calbiochem) and 100 nM LDN (Calbiochem). Single cell suspension was transferred to AggreWell800 plates (STEMCELL Technologies) enabling the formation of aggregates consisting of 8000 cells. After 5 days neural aggregates were transferred onto plates coated with poly-L-ornithine (Sigma) and laminin (Roche) and allowed to form neural rosettes under continued dual SMAD inhibition (SB-431542 and LDN) in basic medium supplemented with FGF. Neural rosettes were selectively isolated using STEMdiff™ Neural Rosette Selection Reagent (STEMCELL Technologies), replated onto dishes coated with poly-L-ornithine and Laminin521 (BioLamina) and expanded in basic medium supplemented with 10 ng/ml FGF (Peprotech), 10 ng/ml EGF (RnD), and 20 ng/ml BDNF (Peprotech). When reaching confluency, cells were enzymatically dissociated with 0.05% Trypsin/EDTA (Gibco, Invitrogen) and sub-cultured. Continued passaging in basic medium supplemented with FGF, EGF and BDNF leads to a stable neural progenitor cell line (NPC line) within 10 to 20 passages. A stable neural progenitor cell line is defined by its capacity to self-renew and by the expression of the developmental stage-specific markers Sox2 and Nestin. Upon specific stimuli, NPCs differentiate into neuronal (MAP2+, Tau+, HuC/D+) and astroglial (GFAP+) progenies (Dunkley et al., 2015 Proteomics Clin Appl. Vol. 7-8 pp. 684-94).

NPC Culture

Conditions for NPC culture have been described previously and were used with slight modifications (Boissart et al., 2013 Transl Psychiatry. 3:e294). In brief, cells were maintained in dishes coated with Laminin521 (BioLamina) and cultured in basic medium [composed of equal volumes of DMEM:F12 Glutamax medium and Neurobasal medium (Gibco, Invitrogen), supplemented with 1×B27 (Gibco, Invitrogen), 1×N2 (Gibco, Invitrogen), 0.1 mM beta-mercaptoethanol (Gibco, Invitrogen)] and supplemented with 10 ng/ml FGF (Peprotech), 10 ng/ml EGF (RnD), and 20 ng/ml BDNF (Peprotech).

Differentiation into Neuronal Cell Culture

To induce neuronal differentiation of NPC, cells were dissociated with 0.05% Trypsin/EDTA (Gibco, Invitrogen) into single cell suspension and seeded onto Laminin521 (BioLamina) coated dishes at a density of 12.000 cells/cm2 and maintained in basic medium supplemented with 200 ng/ml Shh (Peprotech), 100 ng/ml FGF8 (Peprotech), and 100 µM ascorbic acid phosphate (Sigma) for a period of 7 days. Subsequently, cells were replated in basal medium supplemented with 20 ng/ml BDNF (Peprotech), 10 ng/ml GDNF (Peprotech), 0.5 mM cAMP (BIOLOG Life Science), and 100 µM ascorbic acid phosphate (Sigma) at a density of 45000 cells/cm2 and differentiated for a period of 21 days. At day 21 of differentiation, differentiated neuronal cultures were replated onto the screening-compatible plate format. Replating was performed by dissociating the cultures with Accutase (Innovative Cell Technologies Inc.) into a single cell suspension. Cells were seeded at a density of 200.000 cells/cm2 in presence of 10 µM Y-27632 (a cell-permeable, reversible, inhibitor of Rho kinases from Calbiochem) into the 384 well microtiter plates for final oligonucleotides screening assay. Neuronal cultures were further differentiated for additional 7 days in basal medium supplemented with 20 ng/ml BDNF (Peprotech), 10 ng/ml GDNF (Peprotech), 0.5 mM cAMP (BIOLOG Life Science), and 100 µM ascorbic acid phosphate (Sigma). Differentiation medium was exchanged twice per week. After a total differentiation period of 35 days neuronal cell cultures were ready for oligonucleotide treatment.

Screening Oligonucleotides in Human Neuronal Cell Cultures—384 Well System

For screening, oligonucleotide stocks were pre-diluted to the indicated concentrations with water into 384 well microtiter plates (compound plate). The plate layout served as a treatment template. Two microliter oligonucleotide dilution from each well was transferred from the compound plate to a respective culture plate. All liquid handling was done under sterile conditions in a laminar flow using a semi-automated laboratory robotic system (Beckmancoulter). Neuronal cell cultures were incubated with oligonucleotides for 5 days without media change. Subsequently, neuronal cultures were lysed and processed for qPCR assay with RealTime ready Cell lysis and RNA Virus Master kit (Roche). Liquid handling was performed using a semi-automated laboratory robotic system (Beckmancoulter). Samples were analyzed by a Lightcycler480 real-time PCR system (Roche).

Activity of the oligonucleotides was assessed by qPCR monitoring transcript abundance of UBE3A using the following primers and probes

```
UBE3a-Sense:
Forward primer:
                                    (SEQ ID NO: 837)
ATATGTGGAAGCCGGAATCT, Reverse primer:
                                    (SEQ ID NO: 838)
TCCCAGAACTCCCTAATCAGAA, Internal probe labeled with dye FAM:
                                    (SEQ ID NO: 839)
ATGACGGTGGCTATACCAGG
```

The RT-qPCR was multiplexed with PPIA (peptidylprolyl isomerase A) as housekeeping gene for normalization. PPIA primers and probe labeled with the dye VIC were purchased from Thermo Fisher Scientific (assay ID Hs99999904_m1). Each plate includes a non-targeting oligonucleotide (mock) as negative control (TTGaataagtggaTGT (SEQ ID NO: 846)) and a reference oligonucleotide CMP ID NO: 41_1, resulting in up-regulation of UBE3A mRNA.

Selectivity of oligonucleotides was verified by counter screening for SNORD115 transcript, which is located upstream of SNORD109B on chromosome 15. Expression of SNORD115 was monitored by qPCR using the following primers and probe

```
Forward primer:
                                    (SEQ ID NO: 840)
GGGTCAATGATGAGAACCTTAT, Reverse primer
                                    (SEQ ID NO: 841)
GGGCCTCAGCGTAATCCTATT, Internal probe labeled with the dye FAM:
                                    (SEQ ID NO: 842)
TTCTGAAGAGAGGTGATGACTTAAAA
```

The RT-qPCR was multiplexed with PPIA (Thermo Fisher Scientific) upon oligonucleotide treatment.

The reduction of the SNHG14 transcript downstream of SNORD109B (also termed the UBE3A suppressor) was measured by RT-qPCR using the following primers and probe

```
Forward primer:
                                    (SEQ ID NO: 843)
ATCCGAGGCATGAATCTCAC, Reverse primer:
                                    (SEQ ID NO: 844)
CAGGCCAAAACCCTTGATAA, Internal probe labeled with dye FAM:
                                    (SEQ ID NO: 845)
TTGCTGAGCATTTTTGCATC
```

The RT-qPCR was multiplexed with PPIA (Thermo Fisher Scientific).

Data are presented as average % expression relative to mock across all plates and normalized to the reference oligonucleotide to account for plate to plate variation.

Screening Oligonucleotides in Human Neuronal Cell Cultures—96 Well System

For screening, oligonucleotide stocks were pre-diluted to the indicated concentrations with water into 96 well microtiter plates (compound plate). The plate layout served as a treatment template. Two microliter oligonucleotide dilution from each well was transferred from the compound plate to a respective culture plate. All liquid handling was done under sterile conditions in a laminar flow using a semi-automated laboratory robotic system (Beckman Coulter). Neuronal cell cultures were incubated with oligonucleotides for 5 days without media change. Subsequently, neuronal cultures were lysed and RNA purified using RNA purification kit Pure Link Pro96 (12173011A) LifeTechnologies. Liquid handling was performed using a semi-automated laboratory robotic system (Beckmancoulter). qPCR analysis of Ube3a and Ube3a-ATS was carried out on a ViiA™ 7 Real-Time PCR System Thermo Fisher Scientific using the qScript™ XLT 1-Step RT-qPCR ToughMix Low ROX, from Quanta (95134-50).

The following primers and probes were used:

```
qPCR UBE3a-Sense:
Forward primer:
                                    (SEQ ID NO: 697)
ATATGTGGAAGCCGGAATCT, Reverse primer:
                                    (SEQ ID NO: 698)
TCCCAGAACTCCCTAATCAGAA, Internal probe labeled with dye FAM:
                                    (SEQ ID NO: 699)
ATGACGGTGGCTATACCAGG
``` qPCR SNHG14 transcript downstream of SNORD109B (also termed the UBE3A suppressor): Commercially available primer and probe set from ThermoFisher: Hs01372957_m1. These primers amplifies a 87 bp exon-exon spanning sequence in the Genbank transcript AF400500.1

QPCR GAPDH Transcript:

Commercially available primer and probe set from Thermofisher: Gene Symbol: with following assay details: RefSeq: NM_002046.3, Probe Exon Location:3, Amplicon Size: 122 bp. Corresponding TaqMan Assay ID: Hs99999905_m1.

The RT-qPCR for both Ube3a and Ube3a-ATS was multiplexed with GAPDH as housekeeping gene for normalization. Each plate includes a non-targeting oligonucleotide (mock) as negative control (TTGaataagtggaTGT (SEQ ID NO: 846)) and a reference oligonucleotide CMP ID NO: 21_1, resulting in up-regulation of UBE3A mRNA. Moreover panel of oligos not targeting Ub3a or SNHG14 transcript downstream of SNORD109B (also termed the UBE3A suppressor) were included to monitor the assay noise and risk of detecting false positives. These were randomly distributed over the plates.
Control Oligonucleotides:

CGAaccactgaaCAA (SEQ ID NO: 819)

CGAaccactgaacAAA (SEQ ID NO: 820)

CGAagtgcacaCG (SEQ ID NO: 821)

GCGtaaagagaGGT (SEQ ID NO: 822)

GAGAaggcacagaCGG (SEQ ID NO: 823)

GCGaagtgcacaCGG (SEQ ID NO: 824)

GAGaaggcacagaCGG (SEQ ID NO: 825)

CGAaccactgAACA (SEQ ID NO: 826)

GAAccactgaacAAA (SEQ ID NO: 827)

caGCGtaaagagaGG (SEQ ID NO: 828)

GCgtaaagagAGG (SEQ ID NO: 829)

CGAaccactgaAC (SEQ ID NO: 830)

CGAAccactgaaCAAA (SEQ ID NO: 831)

AGCgaagtgcacaCGG (SEQ ID NO: 832)

AGGtgaagcgaAGTG (SEQ ID NO: 833)

TAGTaaactgagCCA (SEQ ID NO: 834)

AGAaggcacagaCGG (SEQ ID NO: 835)

CCGcagtatggaTCG (SEQ ID NO: 836)

Example 1—Oligonucleotide Activity in Mouse Primary Neuronal Cell Cultures

Oligonucleotides targeting the part of SNHG14 long non-coding RNA which is antisense to the UBE3A pre-mRNA (position 55319 to 141053 of SEQ ID NO: 1) were tested for their ability to reduce the SNHG14 long non-coding RNA transcript preventing UBE3A expression (also termed UBE3A suppressor or UBE3A-SUP in the data table) and their ability to induce UBE3A mRNA re-expression in mouse primary cortical neuron cell cultures, obtained as described in the "Materials and methods" section above. The oligonucleotide concentration was 5 microM.

The oligonucleotides were screened according to the protocol for screening in mouse cortical neuron cell cultures described in the section "Materials and methods". The results are shown in table 4.

TABLE 4

Oligonucleotide activity in primary mouse neuronal cell cultures.

| CMP ID NO | oligonucleotide | % of Mock UBE3A_SUP | sd | % of Mock UBE3A | sd |
|---|---|---|---|---|---|
| 95_1 | CTCAtacttgctttaAT | 3.6 | 0.1 | 154.1 | 15.1 |
| 95_2 | CTcatacttgctttaAT | 15.9 | 2.6 | 119.8 | 12.4 |
| 96_1 | ACatctcatacttGCTT | 4.0 | 0.5 | 149.9 | 11.5 |
| 96_2 | ACatctcatacttgcTT | 9.3 | 3.9 | 139.9 | 36.4 |
| 96_3 | ACatctcatacttgCTT | 3.1 | 0.2 | 143.2 | 3.9 |
| 97_1 | ACatctcatactTGCT | 4.0 | 1.5 | 154.5 | 10.0 |
| 97_2 | ACatctcatacttgCT | 6.1 | 1.7 | 141.1 | 14.1 |
| 97_3 | ACatctcatacttGCT | 3.7 | 0.6 | 162.7 | 15.0 |
| 97_4 | ACATctcatacttgCT | 5.2 | 0.4 | 156.7 | 24.4 |
| 98_1 | TAcatctcatactTGCT | 5.0 | 0.9 | 159.0 | 15.6 |
| 98_2 | TAcatctcatacttgCT | 15.5 | 5.3 | 130.4 | 3.4 |
| 98_3 | TACatctcatacttgCT | 4.7 | 0.4 | 140.3 | 38.2 |
| 101_1 | TACatctcatactTGC | 2.6 | 0.5 | 152.6 | 10.2 |
| 101_2 | TAcatctcatacttGC | 19.2 | 6.0 | 112.0 | 15.0 |
| 101_3 | TAcatctcatactTGC | 3.5 | 0.4 | 117.2 | 13.7 |

TABLE 4-continued

Oligonucleotide activity in primary mouse neuronal cell cultures.

| CMP ID NO | oligonucleotide | % of Mock UBE3A_SUP | sd | % of Mock UBE3A | sd |
|---|---|---|---|---|---|
| 101_4 | TACAtctcatacttGC | 3.0 | 0.7 | 140.5 | 12.4 |
| 100_1 | CTAcatctcatactTGC | 5.4 | 0.8 | 160.4 | 4.1 |
| 100_2 | CTacatctcatacttGC | 9.6 | 3.7 | 159.2 | 14.5 |
| 100_3 | CTacatctcatactTGC | 3.0 | 0.1 | 133.2 | 5.9 |
| 99_2 | CCtacatctcatacttGC | 7.8 | 1.4 | 150.7 | 11.0 |
| 99_3 | CCtacatctcatactTGC | 3.2 | 0.6 | 134.7 | 12.5 |
| 99_4 | CCtacatctcatacTTGC | 2.7 | 0.2 | 145.2 | 4.7 |
| 102_1 | CCTAcatctcatactTG | 5.8 | 1.7 | 127.0 | 24.5 |
| 102_2 | CCtacatctcatactTG | 20.2 | 6.6 | 129.7 | 9.2 |
| 102_4 | CCTacatctcatacTTG | 4.0 | 0.6 | 140.2 | 7.2 |
| 102_3 | CCTacatctcatactTG | 3.9 | 1.0 | 133.3 | 10.0 |
| 104_1 | CCTacatctcataCTT | 6.6 | 1.5 | 136.5 | 8.7 |
| 104_3 | CCtacatctcatACTT | 3.5 | 0.4 | 131.4 | 6.0 |
| 103_1 | ACCtacatctcataCTT | 5.8 | 1.4 | 130.8 | 0.7 |
| 103_2 | ACctacatctcatacTT | 11.4 | 2.2 | 123.6 | 12.4 |
| 103_3 | ACctacatctcatACTT | 5.8 | 0.8 | 132.2 | 4.5 |
| 105_1 | TACCtacatctcatacTT | 5.2 | 0.8 | 152.3 | 7.2 |
| 106_1 | TTAcctacatctcataCTT | 13.3 | 3.0 | 140.1 | 17.5 |
| 106_2 | TTacctacatctcatacTT | 21.0 | 1.4 | 116.9 | 15.0 |
| 107_1 | ACCTacatctcataCT | 6.2 | 0.9 | 119.2 | 3.4 |
| 107_2 | ACctacatctcataCT | 14.3 | 7.4 | 142.9 | 13.7 |
| 108_1 | TACCtacatctcataCT | 5.6 | 1.0 | 127.0 | 10.7 |
| 108_2 | TAcctacatctcataCT | 21.4 | 12.5 | 117.1 | 8.5 |
| 109_1 | TTacctacatctcaTACT | 4.4 | 0.4 | 138.9 | 1.2 |
| 109_2 | TTacctacatctcataCT | 22.9 | 3.3 | 117.1 | 13.0 |
| 110_1 | TTAcctacatctcaTAC | 8.7 | 2.1 | 133.2 | 5.1 |
| 110_2 | TTacctacatctcatAC | 21.0 | 5.1 | 111.4 | 11.1 |
| 111_1 | GTtacctacatctCATA | 8.0 | 2.4 | 143.8 | 14.8 |
| 111_2 | GTtacctacatctcaTA | 19.0 | 2.3 | 115.4 | 4.1 |
| 112_1 | GTTacctacatctCAT | 6.6 | 1.4 | 145.5 | 16.8 |
| 112_2 | GTtacctacatctcAT | 15.8 | 4.5 | 120.3 | 8.1 |
| 126_1 | TCACtttccagatatCA | 8.0 | 1.9 | 133.8 | 5.4 |
| 126_3 | TCactttccagatatCA | 53.4 | 75.9 | 112.0 | 11.4 |
| 128_1 | ACATgtccctttataTT | 16.3 | 2.5 | 114.7 | 11.1 |
| 128_2 | ACatgtccctttataTT | 14.8 | 1.1 | 136.9 | 6.2 |
| 129_1 | ACAtgtcccttttaTAT | 11.8 | 1.9 | 135.0 | 14.3 |

TABLE 4-continued

Oligonucleotide activity in primary mouse neuronal cell cultures.

| CMP ID NO | oligonucleotide | % of Mock UBE3A_SUP | sd | % of Mock UBE3A | sd |
|---|---|---|---|---|---|
| 132_1 | CTCAtccctccaagaAA | 9.1 | 1.6 | 131.7 | 8.4 |
| 132_2 | CTcatccctccaagaAA | 11.2 | 3.9 | 159.3 | 17.7 |

Example 2—Oligonucleotide Activity in Human Neuronal Cell Cultures

Oligonucleotides targeting human SNHG14 in the region downstream of SNORD109B corresponding to position 25278410 to 25419462 on chromosome 15 (SEQ ID NO: 1) were tested in patient derived human neuronal cell cultures (see protocol in "Materials and methods" section). The oligonucleotides ability to reduce the SNHG14 transcript in the region downstream of SNORD109B (also termed UBE3A suppressor or UBE3A-SUP in the data table), without affecting expression of SNORD115 was analyzed. Furthermore, the ability to induce UBE3A mRNA re-expression was analyzed.

The oligonucleotides were screened according to the protocol for screening oligonucleotides in human neuronal cell cultures described in the section "Materials and methods" above.

The results are shown in table 5. The expression of UBE3A mRNA has been measured for all compounds, whereas the knock-down of the UBE3A suppressor and the maintenance of SNORD1115 levels have not been analyzed for all compounds.

TABLE 5

Oligonucleotide activity in patient derived human neuronal cell cultures.

| Start SEQ ID NO 1 | CMP ID NO | Target | % of Mock Oligo conc 0.2 µM | sd | % of Mock Oligo conc 1.0 µM | sd | % of Mock Oligo conc 5.0 µM | sd |
|---|---|---|---|---|---|---|---|---|
| 1678 | 10_1 | UBE3A | 107 | 14 | 88 | 10 | 151 | 8 |
| 1679 | 12_2 | UBE3A | 100 | 9 | 87 | 14 | 158 | 16 |
| 1687 | 20_1 | UBE3A | 87 | 7 | 102 | 22 | 213 | 44 |
| 1712 | 21_1 | UBE3A | 127 | 23 | 166 | 6 | 178 | 13 |
| 1712 | 21_1 | UBE3A-SUP | 81 | 3 | 82 | 8 | 72 | 12 |
| 1712 | 21_1 | SNORD115 | 115 | 6 | 142 | 24 | 169 | 26 |
| 4167 | 22_1 | UBE3A | 87 | 5 | 90 | 8 | 146 | 20 |
| 4170 | 27_1 | UBE3A | 94 | 16 | 106 | 11 | 170 | 10 |
| 4171 | 29_2 | UBE3A | 86 | 13 | 100 | 12 | 194 | 35 |
| 4172 | 30_1 | UBE3A | 96 | 6 | 121 | 12 | 209 | 27 |
| 9210 | 35_1 | UBE3A | 88 | 5 | 112 | 23 | 195 | 27 |
| 10838 | 37_1 | UBE3A | 77 | 7 | 85 | 9 | 169 | 24 |
| 15565 | 38_2 | UBE3A | 93 | 11 | 108 | 6 | 167 | 34 |
| 22209 | 42_1 | UBE3A | 125 | 16 | 143 | 14 | 180 | 17 |
| 22209 | 42_1 | UBE3A-SUP | 108 | 14 | 98 | 15 | 85 | 18 |
| 22209 | 42_1 | SNORD115 | 101 | 14 | 93 | 25 | 127 | 21 |
| 30449 | 43_1 | UBE3A | 99 | 5 | 95 | 13 | 115 | 8 |
| 30451 | 44_1 | UBE3A | 99 | 15 | 80 | 20 | 141 | 17 |
| 30451 | 44_2 | UBE3A | 98 | 31 | 104 | 16 | 119 | 7 |
| 30697 | 46_1 | UBE3A | 91 | 8 | 87 | 5 | 167 | 20 |
| 36066 | 49_1 | UBE3A | 95 | 6 | 111 | 10 | 155 | 29 |
| 36066 | 49_1 | UBE3A-SUP | 76 | 7 | 84 | 24 | 110 | 31 |
| 36066 | 49_1 | SNORD115 | 99 | 14 | 111 | 20 | 94 | 6 |
| 36068 | 50_1 | UBE3A | 109 | 15 | 105 | 11 | 92 | 14 |
| 36068 | 50_1 | UBE3A-SUP | 122 | 24 | 93 | 28 | 73 | 7 |
| 36068 | 50_1 | SNORD115 | 120 | 15 | 113 | 12 | 99 | 6 |
| 37206 | 51_1 | UBE3A | 114 | 16 | 101 | 7 | 101 | 3 |
| 37206 | 51_1 | UBE3A-SUP | 128 | 21 | 67 | 9 | 84 | 13 |
| 37206 | 51_1 | SNORD115 | 140 | 26 | 110 | 9 | 100 | 11 |
| 46130 | 52_1 | UBE3A | 139 | 3 | 160 | 1 | 236 | 36 |
| 46130 | 52_1 | UBE3A-SUP | 135 | 16 | 133 | 26 | 160 | 32 |
| 46130 | 52_1 | SNORD115 | 104 | 8 | 119 | 14 | 100 | 8 |
| 48145 | 59_1 | UBE3A | 179 | 3 | 122 | 17 | 115 | NA |
| 48170 | 76_1 | UBE3A | 85 | 16 | 100 | 8 | 155 | 12 |
| 48171 | 80_1 | UBE3A | 120 | 7 | 114 | 10 | 172 | 20 |
| 48171 | 78_1 | UBE3A | 136 | 31 | 103 | 20 | 169 | 11 |
| 48172 | 82_2 | UBE3A | 96 | 11 | 121 | 4 | 186 | 32 |
| 48172 | 84_1 | UBE3A | 95 | 14 | 100 | 8 | 158 | 14 |
| 49343 | 85_1 | UBE3A | 97 | 22 | 121 | 10 | 189 | 17 |
| 49722 | 87_1 | UBE3A | 111 | 9 | 126 | 11 | 177 | 22 |
| 52417 | 92_1 | UBE3A | 133 | 7 | 140 | 30 | 140 | 8 |
| 52417 | 92_1 | UBE3A-SUP | 88 | 14 | 80 | 14 | 82 | 8 |
| 52417 | 92_1 | SNORD115 | 102 | 8 | 114 | 20 | 91 | 9 |

TABLE 5-continued

Oligonucleotide activity in patient derived human neuronal cell cultures.

| Start SEQ ID NO 1 | CMP ID NO | Target | % of Mock Oligo conc 0.2 μM | sd | % of Mock Oligo conc 1.0 μM | sd | % of Mock Oligo conc 5.0 μM | sd |
|---|---|---|---|---|---|---|---|---|
| 52420 | 93_1 | UBE3A | 111 | 14 | 120 | 9 | 126 | 16 |
| 52420 | 93_1 | UBE3A-SUP | 104 | 23 | 82 | 20 | 79 | 8 |
| 52420 | 93_1 | SNORD115 | 110 | 11 | 114 | 17 | 95 | 7 |
| 53953 | 94_1 | UBE3A | 117 | 12 | 147 | 15 | 166 | 15 |
| 53953 | 94_1 | UBE3A-SUP | 92 | 18 | 81 | 5 | 86 | 22 |
| 53953 | 94_1 | SNORD115 | 124 | 33 | 122 | 17 | 106 | 14 |
| 60819 | 95_1 | UBE3A | 103 | 11 | 131 | 14 | 175 | 7 |
| 60819 | 95_1 | UBE3A-SUP | 93 | 13 | 87 | 3 | 74 | 6 |
| 60819 | 95_1 | SNORD115 | 162 | 19 | 158 | 20 | 201 | 11 |
| 60819 | 95_2 | UBE3A | 147 | 10 | 129 | 20 | 117 | 2 |
| 60819 | 95_2 | UBE3A-SUP | 118 | 24 | 87 | 13 | 83 | 8 |
| 60819 | 95_2 | SNORD115 | 104 | 17 | 118 | 10 | 129 | 6 |
| 60823 | 96_1 | UBE3A | 115 | 16 | 135 | 19 | 174 | 17 |
| 60823 | 96_1 | UBE3A-SUP | 104 | 25 | 93 | 32 | 91 | 11 |
| 60823 | 96_2 | UBE3A | 108 | 7 | 114 | 9 | 115 | 13 |
| 60823 | 96_2 | UBE3A-SUP | 99 | 17 | 92 | 19 | 93 | 10 |
| 60824 | 97_1 | UBE3A | 111 | 12 | 134 | 23 | 169 | 14 |
| 60824 | 97_1 | UBE3A-SUP | 110 | 27 | 105 | 33 | 92 | 10 |
| 60824 | 97_2 | UBE3A | 124 | 13 | 126 | 12 | 124 | 11 |
| 60824 | 97_2 | UBE3A-SUP | 113 | 17 | 107 | 33 | 96 | 20 |
| 60824 | 98_1 | UBE3A | 111 | 16 | 119 | 11 | 138 | 14 |
| 60824 | 98_1 | UBE3A-SUP | 118 | 34 | 98 | 23 | 82 | 19 |
| 60824 | 98_1 | SNORD115 | 109 | 11 | 123 | 18 | 114 | 16 |
| 60824 | 98_2 | UBE3A | 128 | 10 | 109 | 7 | 136 | 12 |
| 60824 | 98_2 | UBE3A-SUP | 91 | 15 | 77 | 11 | 110 | 16 |
| 60824 | 98_2 | SNORD115 | 101 | 3 | 110 | 7 | 124 | 11 |
| 60825 | 99_1 | UBE3A | 125 | 6 | 115 | 5 | 131 | 10 |
| 60825 | 99_1 | UBE3A-SUP | 139 | 18 | 121 | 34 | 127 | 45 |
| 60825 | 99_1 | SNORD115 | 110 | 18 | 112 | 12 | 99 | 19 |
| 60825 | 99_2 | UBE3A | 120 | 21 | 111 | 11 | 135 | 22 |
| 60825 | 99_2 | UBE3A-SUP | 96 | 21 | 79 | 15 | 75 | 11 |
| 60825 | 99_2 | SNORD115 | 104 | 34 | 113 | 22 | 131 | 24 |
| 60825 | 100_1 | UBE3A | 123 | 34 | 139 | 34 | 145 | 21 |
| 60825 | 100_1 | UBE3A-SUP | 104 | 37 | 127 | 46 | 99 | 17 |
| 60825 | 100_2 | UBE3A | 124 | 46 | 138 | 37 | 145 | 31 |
| 60825 | 100_2 | UBE3A-SUP | 111 | 36 | 120 | 47 | 92 | 11 |
| 60825 | 101_1 | UBE3A | 112 | 18 | 123 | 15 | 150 | 13 |
| 60825 | 101_1 | UBE3A-SUP | 96 | 18 | 102 | 14 | 88 | 12 |
| 60825 | 101_2 | UBE3A | 118 | 15 | 138 | 24 | 139 | 32 |
| 60825 | 101_2 | UBE3A-SUP | 100 | 29 | 110 | 39 | 92 | 10 |
| 60826 | 102_1 | UBE3A | 132 | 17 | 120 | 7 | 125 | 9 |
| 60826 | 102_1 | UBE3A-SUP | 113 | 16 | 83 | 5 | 88 | 18 |
| 60826 | 102_1 | SNORD115 | 121 | 36 | 131 | 23 | 100 | 9 |
| 60826 | 102_2 | UBE3A | 90 | 6 | 116 | 23 | 103 | 7 |
| 60826 | 102_2 | UBE3A-SUP | 91 | 7 | 90 | 12 | 64 | 18 |
| 60826 | 102_2 | SNORD115 | 116 | 15 | 146 | 27 | 183 | 28 |
| 60827 | 103_1 | UBE3A | 106 | 8 | 112 | 10 | 115 | 9 |
| 60827 | 103_1 | UBE3A-SUP | 99 | 15 | 110 | 28 | 94 | 8 |
| 60827 | 103_2 | UBE3A | 107 | 14 | 120 | 13 | 112 | 14 |
| 60827 | 103_2 | UBE3A-SUP | 97 | 14 | 118 | 38 | 93 | 20 |
| 60827 | 104_1 | UBE3A | 128 | 14 | 111 | 9 | 111 | 6 |
| 60827 | 104_1 | UBE3A-SUP | 111 | 12 | 97 | 9 | 87 | 19 |
| 60827 | 104_1 | SNORD115 | 114 | 10 | 110 | 12 | 109 | 13 |
| 60827 | 104_2 | UBE3A | 108 | 10 | 111 | 16 | 109 | 10 |
| 60827 | 104_2 | UBE3A-SUP | 103 | 13 | 103 | 33 | 89 | 9 |
| 60827 | 105_1 | UBE3A | 122 | 13 | 121 | 12 | 121 | 4 |
| 60827 | 105_1 | UBE3A-SUP | 119 | 7 | 97 | 15 | 93 | 7 |
| 60827 | 105_1 | SNORD115 | 114 | 21 | 128 | 12 | 118 | 9 |
| 60827 | 105_2 | UBE3A | 123 | 5 | 110 | 9 | 114 | 8 |
| 60827 | 105_2 | UBE3A-SUP | 110 | 11 | 89 | 17 | 94 | 21 |
| 60827 | 105_2 | SNORD115 | 102 | 15 | 108 | 16 | 107 | 18 |
| 60827 | 106_1 | UBE3A | 114 | 17 | 133 | 23 | 125 | 9 |
| 60827 | 106_1 | UBE3A-SUP | 112 | 35 | 103 | 15 | 87 | 12 |
| 60827 | 106_2 | UBE3A | 110 | 12 | 130 | 22 | 123 | 14 |
| 60827 | 106_2 | UBE3A-SUP | 105 | 19 | 107 | 27 | 93 | 10 |
| 60828 | 107_1 | UBE3A | 83 | 11 | 117 | 13 | 112 | 6 |
| 60828 | 107_1 | UBE3A-SUP | 86 | 11 | 114 | 16 | 67 | 7 |
| 60828 | 107_1 | SNORD115 | 108 | 17 | 130 | 21 | 137 | 24 |
| 60828 | 107_2 | UBE3A | 143 | 42 | 117 | 10 | 122 | 11 |
| 60828 | 107_2 | UBE3A-SUP | 116 | 12 | 92 | 4 | 100 | 8 |
| 60828 | 107_2 | SNORD115 | 108 | 4 | 127 | 16 | 108 | 14 |
| 60828 | 108_1 | UBE3A | 120 | 7 | 127 | 31 | 132 | 31 |
| 60828 | 108_1 | UBE3A-SUP | 153 | 33 | 118 | 34 | 89 | 17 |
| 60828 | 108_1 | SNORD115 | 114 | 9 | 114 | 9 | 105 | 15 |

TABLE 5-continued

Oligonucleotide activity in patient derived human neuronal cell cultures.

| Start SEQ ID NO 1 | CMP ID NO | Target | % of Mock Oligo conc 0.2 µM | sd | % of Mock Oligo conc 1.0 µM | sd | % of Mock Oligo conc 5.0 µM | sd |
|---|---|---|---|---|---|---|---|---|
| 60828 | 108_2 | UBE3A | 122 | 18 | 133 | 26 | 128 | 9 |
| 60828 | 108_2 | UBE3A-SUP | 101 | 19 | 100 | 28 | 89 | 17 |
| 60828 | 109_1 | UBE3A | 108 | 10 | 129 | 14 | 128 | 5 |
| 60828 | 109_1 | UBE3A-SUP | 106 | 21 | 107 | 24 | 84 | 8 |
| 60828 | 109_2 | UBE3A | 109 | 11 | 110 | 8 | 111 | 13 |
| 60828 | 109_2 | UBE3A-SUP | 95 | 15 | 86 | 14 | 83 | 9 |
| 60829 | 110_1 | UBE3A | 104 | 6 | 83 | 3 | 101 | 15 |
| 60829 | 110_1 | UBE3A-SUP | 100 | 13 | 95 | 12 | 79 | 4 |
| 60829 | 110_1 | SNORD115 | 126 | 21 | 125 | 6 | 182 | 13 |
| 60829 | 110_2 | UBE3A | 92 | 7 | 87 | 8 | 96 | 7 |
| 60829 | 110_2 | UBE3A-SUP | 99 | 7 | 108 | 9 | 81 | 5 |
| 60829 | 110_2 | SNORD115 | 118 | 15 | 139 | 22 | 198 | 39 |
| 60830 | 111_1 | UBE3A | 110 | 6 | 122 | 13 | 124 | 10 |
| 60830 | 111_1 | UBE3A-SUP | 104 | 14 | 90 | 28 | 79 | 11 |
| 60830 | 111_2 | UBE3A | 115 | 10 | 120 | 15 | 121 | 10 |
| 60830 | 111_2 | UBE3A-SUP | 114 | 20 | 89 | 19 | 87 | 9 |
| 60831 | 112_1 | UBE3A | 93 | 8 | 94 | 13 | 106 | 10 |
| 60831 | 112_1 | UBE3A-SUP | 97 | 1 | 68 | 29 | 82 | 7 |
| 60831 | 112_1 | SNORD115 | 116 | 20 | 110 | 13 | 158 | 20 |
| 60831 | 112_2 | UBE3A | 83 | 8 | 78 | 7 | 83 | 6 |
| 60831 | 112_2 | UBE3A-SUP | 106 | 35 | 80 | 23 | 69 | 9 |
| 60831 | 112_2 | SNORD115 | 107 | 6 | 106 | 8 | 159 | 21 |
| 62198 | 113_1 | UBE3A | 110 | 3 | 122 | 6 | 134 | 9 |
| 62198 | 113_1 | UBE3A-SUP | 113 | 20 | 85 | 19 | 79 | 24 |
| 62198 | 113_1 | SNORD115 | 116 | 18 | 123 | 9 | 91 | 9 |
| 62284 | 115_1 | UBE3A | 105 | 14 | 98 | 19 | 141 | 36 |
| 62422 | 116_1 | UBE3A | 130 | 19 | 142 | 29 | 172 | 18 |
| 62423 | 117_1 | UBE3A | 76 | 8 | 93 | 13 | 171 | 17 |
| 62439 | 118_1 | UBE3A | 75 | 7 | 88 | 9 | 150 | 19 |
| 66378 | 119_1 | UBE3A | 96 | 14 | 93 | 5 | 110 | 10 |
| 77565 | 126_1 | UBE3A | 94 | 6 | 113 | 5 | 125 | 14 |
| 77565 | 126_1 | UBE3A-SUP | 83 | 17 | 95 | 33 | 85 | 5 |
| 77565 | 126_1 | SNORD115 | 105 | 11 | 123 | 19 | 152 | 15 |
| 77565 | 126_2 | UBE3A | 95 | 5 | 126 | 9 | 111 | 2 |
| 77565 | 126_2 | UBE3A-SUP | 77 | 27 | 106 | 21 | 83 | 15 |
| 77565 | 126_2 | SNORD115 | 115 | 17 | 157 | 13 | 180 | 15 |
| 92321 | 128_1 | UBE3A | 102 | 7 | 91 | 5 | 111 | 13 |
| 92321 | 128_1 | UBE3A-SUP | 115 | 3 | 104 | 25 | 91 | 13 |
| 92321 | 128_1 | SNORD115 | 135 | 9 | 132 | 12 | 196 | 35 |
| 92321 | 128_2 | UBE3A | 91 | 5 | 96 | 8 | 104 | 8 |
| 92321 | 128_2 | UBE3A-SUP | 112 | 20 | 92 | 20 | 79 | 7 |
| 92321 | 128_2 | SNORD115 | 125 | 7 | 111 | 13 | 169 | 12 |
| 92322 | 129_1 | UBE3A | 101 | 5 | 103 | 2 | 110 | 7 |
| 92322 | 129_1 | UBE3A-SUP | 99 | 39 | 113 | 12 | 94 | 13 |
| 92322 | 129_1 | SNORD115 | 124 | 25 | 114 | 6 | 140 | 13 |
| 92322 | 129_2 | UBE3A | 93 | 2 | 100 | 4 | 113 | 16 |
| 92322 | 129_2 | UBE3A-SUP | 109 | 4 | 102 | 22 | 85 | 7 |
| 92322 | 129_2 | SNORD115 | 103 | 11 | 99 | 9 | 152 | 31 |
| 97154 | 132_1 | UBE3A | 100 | 10 | 128 | 13 | 142 | 13 |
| 97154 | 132_1 | UBE3A-SUP | 103 | 9 | 115 | 8 | 109 | 6 |
| 97154 | 132_1 | SNORD115 | 49 | 7 | 90 | 12 | 143 | 25 |
| 97154 | 132_2 | UBE3A | 111 | 8 | 128 | 17 | 128 | 17 |
| 97154 | 132_2 | UBE3A-SUP | 95 | 7 | 116 | 9 | 105 | 13 |
| 97154 | 133_2 | SNORD115 | 86 | 7 | 106 | 9 | 121 | 9 |
| 97154 | 133_1 | UBE3A | 101 | 3 | 107 | 11 | 124 | 19 |
| 97154 | 133_1 | UBE3A-SUP | 112 | 9 | 117 | 7 | 146 | 25 |
| 97154 | 133_1 | SNORD115 | 60 | 7 | 110 | 15 | 141 | 15 |
| 97154 | 133_2 | UBE3A | 94 | 13 | 116 | 14 | 138 | 12 |
| 97154 | 133_2 | UBE3A-SUP | 116 | 6 | 128 | 13 | 148 | 38 |
| 97154 | 132_2 | SNORD115 | 70 | 5 | 108 | 9 | 160 | 34 |
| 106137 | 137_1 | UBE3A | 83 | 12 | 74 | 11 | 124 | 20 |
| 109404 | 138_1 | UBE3A | 80 | 20 | 92 | 7 | 120 | 21 |
| 110766 | 139_1 | UBE3A | 76 | 5 | 85 | 12 | 121 | 17 |
| 114826 | 140_1 | UBE3A | 87 | 10 | 88 | 11 | 136 | 9 |
| 118637 | 143_1 | UBE3A | 83 | 7 | 104 | 30 | 141 | 28 |
| 118639 | 144_1 | UBE3A | 74 | 17 | 31 | 39 | 106 | 33 |
| 124160 | 145_2 | UBE3A | 89 | 6 | 95 | 10 | 115 | 25 |
| 125499 | 146_1 | UBE3A | 83 | 13 | 76 | 7 | 124 | 16 |
| 125499 | 146_2 | UBE3A | 123 | 30 | 79 | 14 | 102 | 23 |
| 125538 | 150_2 | UBE3A | 82 | 17 | 82 | 7 | 119 | 24 |

Figure 2:
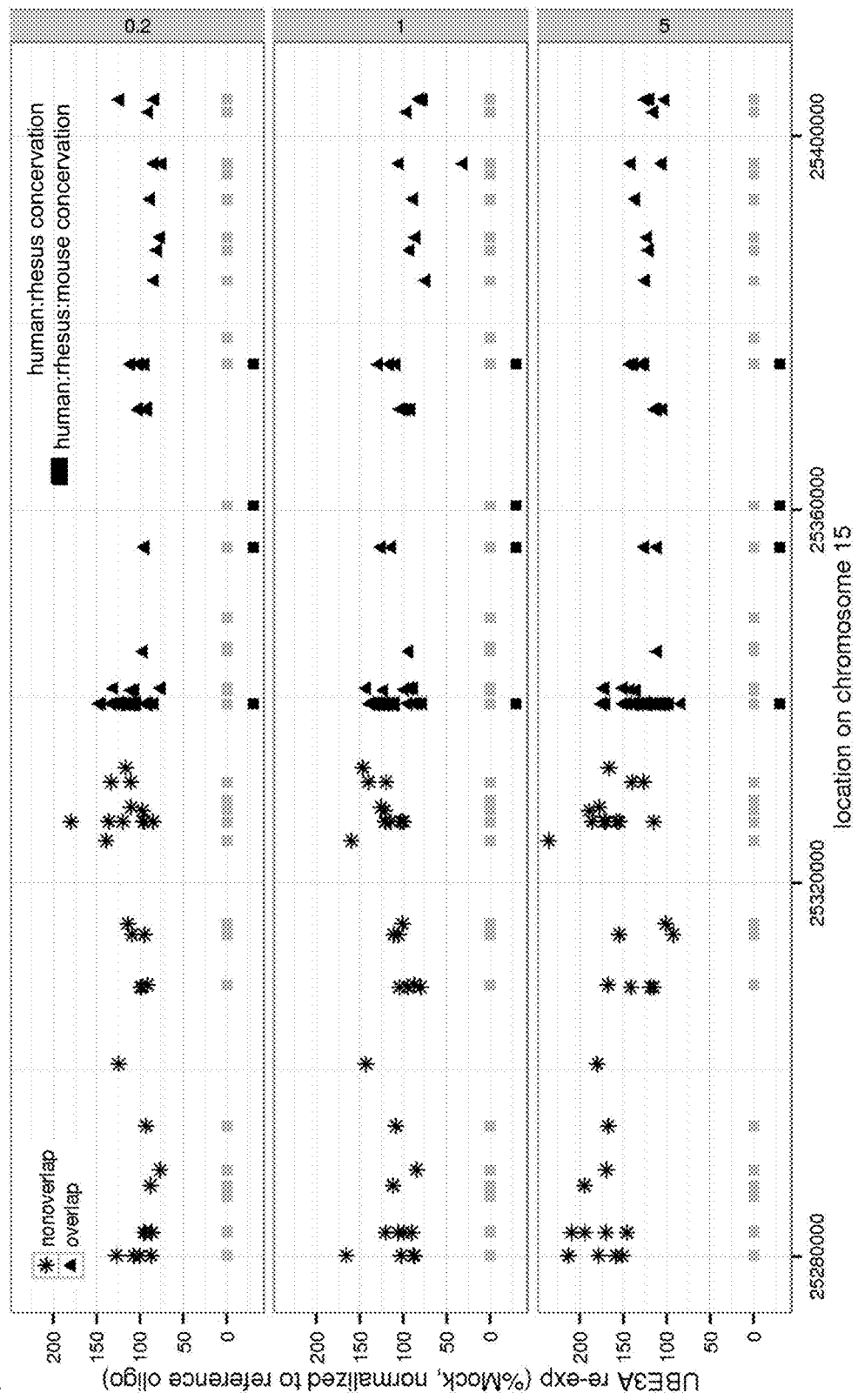
FIG. 2: Representation of the ability of the oligonucleotides, tested in Example 2, to induce re-expression of UBE3A in human neuronal cell cultures. Oligonucleotides complementary to the region of human SNHG14 long non-coding RNA between SNORD109B and the region upstream of the UBE3A coding region (position 1 to 55318 of SEQ ID NO: 1) are indicated with ● nonoverlap. Oligonucleotides complementary to the region of human SNHG14 long non-coding RNA which is antisense to the UBE3A pre-mRNA (position 55319 to 141053 of SEQ ID NO: 1) are indicated with ▲ overlap. Oligonucleotides from Table 3 with conservation to human and rhesus monkey are indicated at the bottom of each plot as ▨. Conservation between human:rhesus:mouse is indicated by ■. The oligonucleotide concentrations were 0.2, 1 and 5 microM as indicated in the right hand side each plot.

Of the 187 compounds tested approximately 90% showed re-expression of UBE3A when compared to the mock oligonucleotide at the 5 micro Molar concentration. The number of oligonucleotides capable of inducing re-expression of UBE3A is higher in the region between position 1 to 55318 of SEQ ID NO: 1 (non-overlapping region) then in the region complementary to UBE3A coding region (overlapping region. FIG. 2 plots the distribution of the oligonucleotides according to their position on chromosome 15 versus the UBE3A mRNA expression relative to the mock oligonucleotide.

For the oligonucleotides where SNORD115 has been tested there is no significant down regulation when compared to mock at 1 and 5 microM.

Example 3—Activity of Oligonucleotides Targeting the SNHG14 Transcript in the Region Downstream of SNORD109B and Upstream of the Region Antisense to the UBE3A Pre-mRNA Oligonucleotides targeting position 4806-54939 of SEQ ID NO: 1 were tested in patient derived human neuronal cell cultures (see protocol in "Materials and methods" section). The oligonucleotides ability to reduce the SNHG14 transcript in the region downstream of SNORD109B (also termed UBE3A suppressor or UBE3A-SUP in the data table. Furthermore, the ability to induce UBE3A mRNA re-expression was analyzed.

The oligonucleotides were screened according to the protocol for screening oligonucleotides in human neuronal cell cultures described in the section "Materials and methods"—"Screening oligonucleotides in human neuronal cell cultures—96 well system"

The results are shown in table 6.

TABLE 6

Oligonucleotide activity in patient derived human neuronal cell cultures.

| Start SEQ ID NO 1 | CMP ID NO | Conc μM | % of Mock UBE3A-SUP | sd | % of Mock UBE3A | sd |
|---|---|---|---|---|---|---|
| 4806 | 151_1 | 0.2 | 66 | 2 | 125 | NA |
| 4806 | 151_1 | 1 | 53 | 10 | NA | NA |
| 4808 | 152_1 | 0.2 | 49 | 6 | 167 | NA |
| 4808 | 152_1 | 1 | 33 | 4 | 289 | NA |
| 4809 | 153_1 | 0.2 | 41 | 1 | 208 | NA |
| 4809 | 153_1 | 1 | 29 | 10 | NA | NA |
| 4811 | 154_1 | 0.2 | 48 | 3 | 282 | NA |
| 4811 | 154_1 | 1 | 37 | 5 | 331 | NA |
| 4812 | 155_1 | 0.2 | 35 | 5 | 286 | 64 |
| 4812 | 155_1 | 1 | 32 | 3 | 327 | 21 |
| 4972 | 156_1 | 0.2 | 60 | 6 | 145 | 6 |
| 4972 | 156_1 | 1 | 46 | 14 | 145 | NA |
| 4973 | 157_1 | 0.2 | 75 | 9 | 128 | 6 |
| 4973 | 157_1 | 1 | 59 | NA | 158 | NA |
| 4979 | 158_1 | 0.2 | 46 | 9 | 131 | NA |
| 4979 | 158_1 | 1 | 37 | 5 | 219 | 8 |
| 5058 | 159_1 | 0.2 | 69 | 6 | 133 | 19 |
| 5058 | 159_1 | 1 | 51 | 14 | NA | NA |
| 5071 | 160_1 | 0.2 | 55 | 8 | 98 | NA |
| 5071 | 160_1 | 1 | 39 | 7 | 136 | 34 |
| 5078 | 161_1 | 0.2 | 65 | 7 | 205 | 18 |
| 5078 | 161_1 | 1 | 51 | 10 | 306 | 31 |
| 5094 | 162_1 | 0.2 | 53 | 5 | 154 | 27 |
| 5094 | 162_1 | 1 | 34 | 8 | 300 | 65 |
| 5096 | 163_1 | 0.2 | 44 | 1 | 206 | 49 |
| 5096 | 163_1 | 1 | 36 | 6 | 316 | NA |
| 5100 | 164_1 | 0.2 | 34 | 3 | 220 | NA |
| 5100 | 164_1 | 1 | 30 | 3 | 227 | 32 |
| 5101 | 165_1 | 0.2 | 38 | 7 | 245 | NA |
| 5101 | 165_1 | 1 | 36 | 4 | 246 | 55 |
| 5218 | 166_1 | 0.2 | 45 | 4 | 240 | NA |
| 5218 | 166_1 | 1 | 36 | 6 | 280 | 44 |
| 5218 | 167_1 | 0.2 | 46 | 2 | 261 | NA |
| 5218 | 167_1 | 1 | 31 | 4 | 346 | 30 |
| 5224 | 168_1 | 0.2 | 39 | 3 | 377 | 40 |
| 5224 | 168_1 | 1 | 33 | 5 | 338 | 65 |
| 5224 | 169_1 | 0.2 | 37 | 4 | 313 | NA |
| 5224 | 169_1 | 1 | 31 | 2 | 308 | 3 |
| 5427 | 170_1 | 0.2 | 89 | 13 | 105 | 26 |
| 5427 | 170_1 | 1 | 117 | 35 | 124 | NA |
| 5434 | 171_1 | 0.2 | 51 | 5 | 164 | 10 |
| 5434 | 171_1 | 1 | 33 | 6 | 213 | 46 |
| 5785 | 172_1 | 0.2 | 46 | 5 | 210 | NA |
| 5785 | 172_1 | 1 | 38 | 4 | 342 | NA |
| 5786 | 173_1 | 0.2 | 54 | 4 | 292 | 61 |
| 5786 | 173_1 | 1 | 39 | 6 | 552 | NA |
| 6341 | 174_1 | 0.2 | 97 | 11 | 126 | 3 |
| 6341 | 174_1 | 1 | 90 | 33 | NA | NA |
| 6694 | 175_1 | 0.2 | 44 | 4 | 226 | NA |
| 6694 | 175_1 | 1 | 35 | 4 | 296 | NA |
| 6695 | 176_1 | 0.2 | 32 | 7 | 297 | 87 |
| 6695 | 176_1 | 1 | 29 | 4 | 263 | 9 |
| 6958 | 177_1 | 0.2 | 58 | 7 | 244 | 76 |
| 6958 | 177_1 | 1 | 47 | NA | NA | NA |
| 7159 | 179_1 | 0.2 | 33 | 4 | 282 | NA |
| 7159 | 179_1 | 1 | 29 | 5 | 289 | 7 |
| 7159 | 178_1 | 0.2 | 43 | 5 | 248 | NA |
| 7159 | 178_1 | 1 | 32 | 4 | 258 | NA |
| 7720 | 180_1 | 0.2 | 75 | 6 | 144 | 36 |
| 7720 | 180_1 | 1 | 54 | 7 | 233 | 26 |
| 7724 | 181_1 | 0.2 | 72 | 6 | 177 | 20 |
| 7724 | 181_1 | 1 | 45 | 19 | 224 | 62 |
| 7725 | 182_1 | 0.2 | 65 | 5 | 139 | 37 |
| 7725 | 182_1 | 1 | 47 | 4 | 208 | 76 |
| 7725 | 183_1 | 0.2 | 103 | 13 | 140 | 2 |
| 7725 | 183_1 | 1 | 74 | 6 | NA | NA |
| 7727 | 184_1 | 0.2 | 45 | 2 | 300 | 107 |
| 7727 | 184_1 | 1 | 35 | 2 | 272 | 16 |
| 8117 | 185_1 | 0.2 | 87 | 17 | 122 | 13 |
| 8117 | 185_1 | 1 | 63 | 17 | 175 | NA |
| 8118 | 186_1 | 0.2 | 40 | 5 | 368 | 105 |
| 8118 | 186_1 | 1 | 33 | 5 | NA | NA |
| 8119 | 187_1 | 0.2 | 62 | 5 | 197 | NA |
| 8119 | 187_1 | 1 | 43 | 13 | 517 | 143 |
| 8120 | 188_1 | 0.2 | 96 | 10 | 136 | 41 |
| 8120 | 188_1 | 1 | 79 | 22 | 146 | 19 |
| 8571 | 189_1 | 0.2 | 53 | 11 | 204 | NA |
| 8571 | 189_1 | 1 | 49 | 24 | 298 | 15 |
| 8573 | 190_1 | 0.2 | 54 | 9 | 140 | 9 |
| 8573 | 190_1 | 1 | 50 | 10 | 267 | 4 |
| 8574 | 191_1 | 0.2 | 56 | 1 | 117 | NA |
| 8574 | 191_1 | 1 | 57 | 13 | 199 | NA |
| 8575 | 192_1 | 0.2 | 56 | 9 | 165 | 10 |
| 8575 | 192_1 | 1 | 54 | 13 | 246 | NA |
| 8576 | 193_1 | 0.2 | 56 | 6 | 185 | 7 |
| 8576 | 193_1 | 1 | 52 | 8 | 330 | 35 |
| 8585 | 194_1 | 0.2 | 47 | 2 | 302 | NA |
| 8585 | 194_1 | 1 | 39 | 7 | NA | NA |
| 8819 | 195_1 | 0.2 | 62 | 10 | 155 | 10 |
| 8819 | 195_1 | 1 | 41 | 3 | 192 | 7 |
| 8820 | 196_1 | 0.2 | 55 | 12 | 237 | 69 |
| 8820 | 196_1 | 1 | 40 | 3 | 278 | 26 |
| 8887 | 197_1 | 0.2 | 69 | 15 | 301 | 59 |
| 8887 | 197_1 | 1 | 58 | 7 | 383 | 92 |
| 9150 | 198_1 | 0.2 | 49 | 6 | NA | NA |
| 9150 | 198_1 | 1 | 43 | 3 | 365 | 38 |
| 9201 | 199_1 | 0.2 | 79 | 23 | 88 | 42 |
| 9201 | 199_1 | 1 | 64 | 24 | 140 | 22 |
| 9202 | 201_1 | 0.2 | 61 | 10 | NA | NA |
| 9202 | 201_1 | 1 | 45 | 8 | 343 | 27 |
| 9202 | 200_1 | 0.2 | 47 | 3 | 287 | 76 |
| 9202 | 200_1 | 1 | 41 | 4 | 281 | NA |
| 9203 | 202_1 | 0.2 | 55 | 17 | 166 | 92 |
| 9203 | 202_1 | 1 | 40 | 5 | 297 | 54 |
| 9209 | 203_1 | 0.2 | 60 | 1 | 122 | NA |
| 9209 | 203_1 | 1 | 40 | 14 | 204 | 8 |
| 9210 | 204_1 | 0.2 | 43 | 2 | 216 | NA |
| 9210 | 204_1 | 1 | 37 | 3 | 409 | NA |
| 9210 | 205_1 | 0.2 | 45 | 8 | 187 | NA |
| 9210 | 205_1 | 1 | 37 | 22 | 336 | 18 |
| 9211 | 206_1 | 0.2 | 51 | 10 | 384 | 17 |

TABLE 6-continued

Oligonucleotide activity in patient derived human neuronal cell cultures.

| Start SEQ ID NO 1 | CMP ID NO | Conc µM | % of Mock UBE3A-SUP | sd | % of Mock UBE3A | sd |
|---|---|---|---|---|---|---|
| 9211 | 206_1 | 1 | 42 | 3 | 381 | 35 |
| 9211 | 207_1 | 0.2 | 65 | 8 | 301 | 28 |
| 9211 | 207_1 | 1 | 50 | 5 | 272 | 53 |
| 9212 | 35_2 | 0.2 | 42 | 11 | 203 | 16 |
| 9212 | 35_2 | 1 | 44 | 18 | 335 | NA |
| 9212 | 208_1 | 0.2 | 64 | 5 | 147 | 58 |
| 9212 | 208_1 | 1 | 50 | 6 | 260 | 73 |
| 9213 | 209_1 | 0.2 | 57 | 7 | NA | NA |
| 9213 | 209_1 | 1 | 49 | 4 | 346 | 31 |
| 9214 | 210_1 | 0.2 | 49 | 7 | 139 | NA |
| 9214 | 210_1 | 1 | 45 | 7 | 223 | 59 |
| 10832 | 211_1 | 0.2 | 70 | 6 | 147 | 10 |
| 10832 | 211_1 | 1 | 56 | 9 | 200 | 38 |
| 10837 | 212_1 | 0.2 | 59 | 9 | 146 | 46 |
| 10837 | 212_1 | 1 | 41 | 6 | 226 | 47 |
| 10838 | 213_1 | 0.2 | 50 | 8 | 247 | 69 |
| 10838 | 213_1 | 1 | 44 | 12 | 307 | NA |
| 10877 | 214_1 | 0.2 | 108 | 21 | 115 | 1 |
| 10877 | 214_1 | 1 | 92 | 37 | 88 | 32 |
| 11434 | 215_1 | 0.2 | 97 | 12 | 81 | 23 |
| 11434 | 215_1 | 1 | 80 | 26 | 111 | 11 |
| 11435 | 216_1 | 0.2 | 90 | 16 | 87 | NA |
| 11435 | 216_1 | 1 | 82 | 29 | 82 | 21 |
| 11436 | 217_1 | 0.2 | 87 | 6 | 83 | 11 |
| 11436 | 217_1 | 1 | 68 | 26 | 123 | NA |
| 11438 | 218_1 | 0.2 | 57 | 5 | 133 | NA |
| 11438 | 218_1 | 1 | 44 | 16 | 188 | NA |
| 11439 | 219_1 | 0.2 | 84 | 1 | 93 | NA |
| 11439 | 219_1 | 1 | 66 | 22 | 113 | 29 |
| 11464 | 220_1 | 0.2 | 67 | 9 | 209 | 51 |
| 11464 | 220_1 | 1 | 41 | 6 | 256 | 33 |
| 11507 | 221_1 | 0.2 | 59 | 6 | 237 | NA |
| 11507 | 221_1 | 1 | 40 | 63 | 320 | NA |
| 11508 | 222_1 | 0.2 | 53 | 7 | 195 | NA |
| 11508 | 222_1 | 1 | 48 | 12 | 302 | NA |
| 11511 | 223_1 | 0.2 | 41 | 3 | 210 | 6 |
| 11511 | 223_1 | 1 | 37 | 9 | 273 | NA |
| 11513 | 224_1 | 0.2 | 22 | 8 | 288 | 91 |
| 11513 | 224_1 | 1 | 26 | 5 | 360 | 46 |
| 11514 | 225_1 | 0.2 | 98 | 17 | 98 | 31 |
| 11514 | 225_1 | 1 | 68 | 16 | 129 | 11 |
| 11736 | 226_1 | 0.2 | 69 | 8 | 197 | 80 |
| 11736 | 226_1 | 1 | 55 | 7 | 329 | 66 |
| 12361 | 227_1 | 0.2 | 48 | 8 | 183 | 56 |
| 12361 | 227_1 | 1 | 37 | 4 | 193 | 46 |
| 12794 | 228_1 | 0.2 | 38 | 9 | 201 | 71 |
| 12794 | 228_1 | 1 | 32 | 2 | 362 | 48 |
| 12795 | 229_1 | 0.2 | 50 | 12 | 161 | 30 |
| 12795 | 229_1 | 1 | 34 | 7 | 301 | 35 |
| 12796 | 230_1 | 0.2 | 44 | 12 | 237 | 86 |
| 12796 | 230_1 | 1 | 32 | 3 | 379 | 106 |
| 12894 | 232_1 | 0.2 | 91 | 17 | 79 | 27 |
| 12894 | 232_1 | 1 | 66 | 10 | 99 | 24 |
| 12894 | 231_1 | 0.2 | 80 | 5 | 89 | NA |
| 12894 | 231_1 | 1 | 57 | 14 | 164 | 31 |
| 12895 | 234_1 | 0.2 | 88 | 11 | 75 | 32 |
| 12895 | 234_1 | 1 | 68 | 19 | 91 | 24 |
| 12895 | 233_1 | 0.2 | 57 | 5 | 199 | 37 |
| 12895 | 233_1 | 1 | 38 | 7 | 249 | 57 |
| 12896 | 235_1 | 0.2 | 72 | 3 | 176 | 9 |
| 12896 | 235_1 | 1 | 45 | 3 | 251 | 42 |
| 13223 | 236_1 | 0.2 | 40 | 3 | 267 | 66 |
| 13223 | 236_1 | 1 | 31 | 3 | 270 | 23 |
| 13224 | 238_1 | 0.2 | 33 | 3 | 265 | NA |
| 13224 | 238_1 | 1 | 28 | 4 | 265 | 6 |
| 13224 | 237_1 | 0.2 | 38 | 2 | 212 | NA |
| 13224 | 237_1 | 1 | 31 | 1 | 254 | 31 |
| 13225 | 239_1 | 0.2 | 42 | 5 | 317 | 113 |
| 13225 | 239_1 | 1 | 29 | 7 | 215 | 26 |
| 13226 | 240_1 | 0.2 | 38 | 7 | 223 | NA |
| 13226 | 240_1 | 1 | 32 | 5 | 232 | 16 |
| 15115 | 241_1 | 0.2 | 61 | 8 | 377 | 15 |
| 15115 | 241_1 | 1 | 41 | 3 | 377 | 43 |
| 15258 | 242_1 | 0.2 | 66 | 14 | 133 | 35 |
| 15258 | 242_1 | 1 | 55 | 10 | 170 | 17 |
| 15568 | 243_1 | 0.2 | 62 | 13 | 192 | 58 |
| 15568 | 243_1 | 1 | 41 | 11 | 309 | 5 |
| 15570 | 244_1 | 0.2 | 53 | 17 | 252 | 59 |
| 15570 | 244_1 | 1 | 44 | 5 | 332 | 52 |
| 15572 | 245_1 | 0.2 | 57 | 21 | 321 | 122 |
| 15572 | 245_1 | 1 | 49 | 7 | 407 | 77 |
| 15573 | 246_1 | 0.2 | 47 | 16 | 348 | 129 |
| 15573 | 246_1 | 1 | 40 | 7 | 410 | 69 |
| 15574 | 247_1 | 0.2 | 48 | 14 | 326 | 116 |
| 15574 | 247_1 | 1 | 44 | 8 | 411 | 36 |
| 15722 | 248_1 | 0.2 | 51 | 3 | 258 | 17 |
| 15722 | 248_1 | 1 | 36 | 3 | 230 | NA |
| 16597 | 249_1 | 0.2 | 66 | 19 | 111 | 39 |
| 16597 | 249_1 | 1 | 54 | 14 | 174 | 44 |
| 16603 | 250_1 | 0.2 | 67 | 26 | 89 | 31 |
| 16603 | 250_1 | 1 | 56 | 6 | 172 | 32 |
| 16730 | 251_1 | 0.2 | 36 | 5 | 354 | 41 |
| 16730 | 251_1 | 1 | 31 | 2 | 326 | 75 |
| 16849 | 252_1 | 0.2 | 74 | 17 | 188 | 81 |
| 16849 | 252_1 | 1 | 48 | 17 | 282 | 1 |
| 17089 | 253_1 | 0.2 | 70 | 17 | 98 | 37 |
| 17089 | 253_1 | 1 | 62 | 19 | 153 | 13 |
| 17401 | 254_1 | 0.2 | 42 | 6 | 209 | 83 |
| 17401 | 254_1 | 1 | 29 | 3 | 327 | 49 |
| 24290 | 255_1 | 0.2 | 106 | 13 | 105 | 36 |
| 24290 | 255_1 | 1 | 109 | 21 | 136 | NA |
| 24296 | 256_1 | 0.2 | 92 | 20 | 117 | 30 |
| 24296 | 256_1 | 1 | 93 | 15 | 138 | 21 |
| 24811 | 257_1 | 0.2 | 85 | 12 | 126 | 4 |
| 24811 | 257_1 | 1 | 74 | 12 | 137 | 17 |
| 25032 | 258_1 | 0.2 | 50 | 11 | 329 | 131 |
| 25032 | 258_1 | 1 | 39 | 5 | 411 | 53 |
| 25033 | 259_1 | 0.2 | 40 | 10 | 343 | 50 |
| 25033 | 259_1 | 1 | 31 | 3 | 483 | 84 |
| 25250 | 260_1 | 0.2 | 33 | 10 | 279 | 42 |
| 25250 | 260_1 | 1 | 33 | 4 | 338 | 65 |
| 25251 | 261_1 | 0.2 | 40 | 8 | 209 | 97 |
| 25251 | 261_1 | 1 | 34 | 3 | 370 | 57 |
| 25718 | 262_1 | 0.2 | 56 | 20 | 113 | 48 |
| 25718 | 262_1 | 1 | 45 | 8 | 198 | 65 |
| 25720 | 263_1 | 0.2 | 84 | 7 | 121 | 39 |
| 25720 | 263_1 | 1 | 72 | 11 | 88 | 10 |
| 25721 | 264_1 | 0.2 | 83 | 15 | 87 | 40 |
| 25721 | 264_1 | 1 | 84 | 22 | NA | NA |
| 26331 | 265_1 | 0.2 | 93 | 5 | 88 | 38 |
| 26331 | 265_1 | 1 | 81 | 8 | NA | NA |
| 27165 | 266_1 | 0.2 | 63 | 3 | 117 | 39 |
| 27165 | 266_1 | 1 | 46 | 9 | 174 | 15 |
| 27248 | 267_1 | 0.2 | 81 | 10 | 124 | 17 |
| 27248 | 267_1 | 1 | 59 | 10 | 190 | 112 |
| 29330 | 268_1 | 0.2 | 109 | 4 | 124 | 48 |
| 29330 | 268_1 | 1 | 98 | 28 | 114 | 35 |
| 29635 | 269_1 | 0.2 | 45 | 1 | 218 | 50 |
| 29635 | 269_1 | 1 | 33 | 9 | 267 | NA |
| 29635 | 270_1 | 0.2 | 55 | 5 | 225 | 41 |
| 29635 | 270_1 | 1 | 45 | 8 | NA | NA |
| 29636 | 271_1 | 0.2 | 48 | 2 | 285 | 56 |
| 29636 | 271_1 | 1 | 40 | 7 | 359 | 99 |
| 29636 | 272_1 | 0.2 | 48 | 3 | 166 | 5 |
| 29636 | 272_1 | 1 | 35 | 8 | 293 | 40 |
| 29637 | 273_1 | 0.2 | 56 | 5 | 255 | 47 |
| 29637 | 273_1 | 1 | 46 | 4 | 300 | 105 |
| 29637 | 274_1 | 0.2 | 67 | 7 | 134 | 35 |
| 29637 | 274_1 | 1 | 54 | 7 | 234 | 19 |
| 29661 | 275_1 | 0.2 | 51 | 3 | 167 | 15 |
| 29661 | 275_1 | 1 | 42 | 11 | 251 | NA |
| 29661 | 276_1 | 0.2 | 54 | 5 | 127 | 17 |
| 29661 | 276_1 | 1 | 39 | 8 | 229 | NA |
| 29684 | 277_1 | 0.2 | 40 | 3 | 168 | 73 |
| 29684 | 277_1 | 1 | 31 | 13 | NA | NA |
| 29684 | 278_1 | 0.2 | 46 | 7 | 179 | 2 |
| 29684 | 278_1 | 1 | 36 | 8 | NA | NA |
| 30455 | 279_1 | 0.2 | 102 | 20 | 96 | 34 |
| 30455 | 279_1 | 1 | 86 | 22 | 118 | 23 |
| 30456 | 280_1 | 0.2 | 94 | 23 | 91 | 28 |

TABLE 6-continued

Oligonucleotide activity in patient derived human neuronal cell cultures.

| Start SEQ ID NO 1 | CMP ID NO | Conc µM | % of Mock UBE3A-SUP | sd | % of Mock UBE3A | sd |
|---|---|---|---|---|---|---|
| 30456 | 280_1 | 1 | 83 | 18 | 134 | 36 |
| 30457 | 281_1 | 0.2 | 89 | 23 | 97 | 37 |
| 30457 | 281_1 | 1 | 94 | 23 | 106 | 39 |
| 30458 | 282_1 | 0.2 | 99 | 14 | 77 | 27 |
| 30458 | 282_1 | 1 | 103 | 17 | 96 | 20 |
| 30462 | 283_1 | 0.2 | 66 | 26 | 98 | 36 |
| 30462 | 283_1 | 1 | 56 | 14 | 129 | 13 |
| 30465 | 284_1 | 0.2 | 73 | 11 | 114 | 47 |
| 30465 | 284_1 | 1 | 57 | 10 | 197 | 63 |
| 30601 | 285_1 | 0.2 | 41 | 31 | 311 | 29 |
| 30601 | 285_1 | 1 | 30 | 16 | 373 | 40 |
| 30605 | 286_1 | 0.2 | 40 | 2 | 221 | 86 |
| 30605 | 286_1 | 1 | 33 | 6 | 375 | NA |
| 30609 | 287_1 | 0.2 | 43 | 3 | 267 | 65 |
| 30609 | 287_1 | 1 | 37 | 5 | 332 | 27 |
| 30610 | 288_1 | 0.2 | 46 | 6 | 253 | 79 |
| 30610 | 288_1 | 1 | 38 | 3 | 338 | NA |
| 30667 | 289_1 | 0.2 | 38 | 15 | 325 | 144 |
| 30667 | 289_1 | 1 | 36 | 3 | 461 | 68 |
| 30668 | 290_1 | 0.2 | 74 | 19 | 124 | 54 |
| 30668 | 290_1 | 1 | 58 | 14 | 183 | 20 |
| 30669 | 291_1 | 0.2 | 86 | 18 | 98 | 40 |
| 30669 | 291_1 | 1 | 78 | 12 | 133 | 26 |
| 30670 | 292_1 | 0.2 | 93 | 10 | 86 | 31 |
| 30670 | 292_1 | 1 | 94 | 16 | 127 | 22 |
| 30679 | 293_1 | 0.2 | 85 | 19 | 83 | 21 |
| 30679 | 293_1 | 1 | 87 | 21 | 113 | 23 |
| 30681 | 294_1 | 0.2 | 92 | 17 | 78 | 20 |
| 30681 | 294_1 | 1 | 100 | 19 | 86 | 22 |
| 30682 | 295_1 | 0.2 | 93 | 22 | 101 | 40 |
| 30682 | 295_1 | 1 | 94 | 33 | 101 | 8 |
| 30699 | 296_1 | 0.2 | 80 | 24 | 134 | 6 |
| 30699 | 296_1 | 1 | 47 | 21 | 232 | 36 |
| 30700 | 297_1 | 0.2 | 53 | 5 | 146 | 26 |
| 30700 | 297_1 | 1 | 32 | 8 | NA | NA |
| 30700 | 298_1 | 0.2 | 47 | 4 | 221 | NA |
| 30700 | 298_1 | 1 | 38 | 0 | 294 | NA |
| 30701 | 299_1 | 0.2 | 49 | 4 | 140 | NA |
| 30701 | 299_1 | 1 | 23 | NA | NA | NA |
| 30701 | 300_1 | 0.2 | 50 | 9 | 163 | 19 |
| 30701 | 300_1 | 1 | 39 | 11 | 346 | 11 |
| 30702 | 301_1 | 0.2 | 66 | 9 | 116 | 36 |
| 30702 | 301_1 | 1 | 44 | 14 | 230 | 51 |
| 30711 | 302_1 | 0.2 | 41 | 14 | 288 | 120 |
| 30711 | 302_1 | 1 | 40 | 5 | 422 | 132 |
| 30714 | 303_1 | 0.2 | 45 | 9 | 355 | 94 |
| 30714 | 303_1 | 1 | 31 | 5 | 355 | 8 |
| 30715 | 305_1 | 0.2 | 39 | 4 | 292 | 56 |
| 30715 | 305_1 | 1 | 34 | 12 | 253 | 5 |
| 30715 | 304_1 | 0.2 | 50 | 13 | 263 | 87 |
| 30715 | 304_1 | 1 | 43 | 7 | 285 | 12 |
| 31630 | 306_1 | 0.2 | 92 | 32 | 134 | 48 |
| 31630 | 306_1 | 1 | 85 | 25 | 177 | 26 |
| 31632 | 307_1 | 0.2 | 94 | 24 | 92 | 32 |
| 31632 | 307_1 | 1 | 86 | 17 | 109 | 33 |
| 31633 | 308_1 | 0.2 | 92 | 18 | 78 | 13 |
| 31633 | 308_1 | 1 | 102 | 23 | 98 | 7 |
| 32755 | 310_1 | 0.2 | 47 | 12 | 220 | 40 |
| 32755 | 310_1 | 1 | 40 | 16 | 285 | NA |
| 32755 | 309_1 | 0.2 | 62 | 6 | 167 | NA |
| 32755 | 309_1 | 1 | 40 | 10 | 225 | NA |
| 32756 | 311_1 | 0.2 | 55 | 9 | 128 | 9 |
| 32756 | 311_1 | 1 | 56 | NA | 224 | NA |
| 33366 | 312_1 | 0.2 | 64 | 23 | 121 | 4 |
| 33366 | 312_1 | 1 | 56 | 10 | 137 | 1 |
| 33367 | 313_1 | 0.2 | 81 | 7 | 91 | NA |
| 33367 | 313_1 | 1 | 79 | 22 | 115 | 12 |
| 33368 | 314_1 | 0.2 | 70 | 4 | 103 | NA |
| 33368 | 314_1 | 1 | 57 | 15 | 157 | NA |
| 33369 | 315_1 | 0.2 | 73 | 12 | 87 | 20 |
| 33369 | 315_1 | 1 | 67 | 19 | 155 | NA |
| 33375 | 316_1 | 0.2 | 79 | 18 | 100 | 18 |
| 33375 | 316_1 | 1 | 51 | 14 | 159 | 39 |
| 33377 | 317_1 | 0.2 | 46 | 21 | 248 | 72 |
| 33377 | 317_1 | 1 | 41 | 9 | 313 | NA |
| 33378 | 318_1 | 0.2 | 38 | 17 | 273 | 63 |
| 33378 | 318_1 | 1 | 36 | 7 | 321 | 1 |
| 36606 | 319_1 | 0.2 | 79 | 10 | 154 | 21 |
| 36606 | 319_1 | 1 | 48 | 9 | 233 | 65 |
| 36607 | 320_1 | 0.2 | 60 | 9 | 157 | 18 |
| 36607 | 320_1 | 1 | 49 | 9 | 206 | 25 |
| 38092 | 321_1 | 0.2 | 51 | 10 | 221 | 59 |
| 38092 | 321_1 | 1 | 41 | 5 | 328 | 39 |
| 38297 | 322_1 | 0.2 | 43 | 9 | 298 | 31 |
| 38297 | 322_1 | 1 | 34 | 6 | 365 | 91 |
| 39173 | 323_1 | 0.2 | 98 | 8 | 119 | 27 |
| 39173 | 323_1 | 1 | 82 | 20 | 177 | 21 |
| 39174 | 324_1 | 0.2 | 89 | 8 | 139 | 24 |
| 39174 | 324_1 | 1 | 84 | 23 | 192 | 15 |
| 39175 | 325_1 | 0.2 | 93 | 18 | 167 | 13 |
| 39175 | 325_1 | 1 | 68 | 17 | 203 | 33 |
| 39176 | 326_1 | 0.2 | 79 | 12 | 185 | 83 |
| 39176 | 326_1 | 1 | 55 | 17 | 374 | 107 |
| 39228 | 327_1 | 0.2 | 75 | 12 | 151 | 29 |
| 39228 | 327_1 | 1 | 57 | 8 | 207 | 32 |
| 39230 | 328_1 | 0.2 | 65 | 11 | 176 | 19 |
| 39230 | 328_1 | 1 | 52 | 19 | 357 | NA |
| 39231 | 329_1 | 0.2 | 63 | 19 | 150 | 35 |
| 39231 | 329_1 | 1 | 46 | 6 | 257 | 43 |
| 39563 | 330_1 | 0.2 | 69 | 10 | 116 | 34 |
| 39563 | 330_1 | 1 | 56 | 11 | 196 | NA |
| 39808 | 331_1 | 0.2 | 40 | 8 | 201 | 17 |
| 39808 | 331_1 | 1 | 25 | 5 | 300 | NA |
| 39808 | 332_1 | 0.2 | 40 | 14 | 282 | 109 |
| 39808 | 332_1 | 1 | 33 | 7 | 404 | 81 |
| 39931 | 333_1 | 0.2 | 80 | 11 | 107 | 53 |
| 39931 | 333_1 | 1 | 70 | 16 | 112 | 26 |
| 41114 | 334_1 | 0.2 | 64 | 4 | 113 | NA |
| 41114 | 334_1 | 1 | 28 | NA | 179 | NA |
| 41444 | 335_1 | 0.2 | 57 | 17 | 165 | 39 |
| 41444 | 335_1 | 1 | 46 | 4 | 290 | 40 |
| 41445 | 336_1 | 0.2 | 51 | 2 | 134 | NA |
| 41445 | 336_1 | 1 | 42 | 15 | 238 | NA |
| 41446 | 337_1 | 0.2 | 63 | 1 | 108 | NA |
| 41446 | 337_1 | 1 | 56 | 14 | 151 | 22 |
| 41725 | 338_1 | 0.2 | 91 | 16 | 130 | 50 |
| 41725 | 338_1 | 1 | 75 | 23 | 154 | 27 |
| 41726 | 339_1 | 0.2 | 66 | 20 | 142 | 23 |
| 41726 | 339_1 | 1 | 55 | 14 | 193 | NA |
| 41728 | 340_1 | 0.2 | 60 | 16 | 137 | 23 |
| 41728 | 340_1 | 1 | 51 | 13 | 233 | NA |
| 42167 | 341_1 | 0.2 | 70 | 9 | 138 | 7 |
| 42167 | 341_1 | 1 | 51 | 11 | 182 | 20 |
| 42168 | 343_1 | 0.2 | 67 | 9 | 210 | 92 |
| 42168 | 343_1 | 1 | 52 | 6 | 193 | NA |
| 42168 | 342_1 | 0.2 | 51 | 6 | 183 | NA |
| 42168 | 342_1 | 1 | 46 | 10 | 275 | 14 |
| 42169 | 344_1 | 0.2 | 55 | 1 | 231 | 32 |
| 42169 | 344_1 | 1 | 35 | 3 | NA | NA |
| 42169 | 345_1 | 0.2 | 55 | 7 | 164 | 41 |
| 42169 | 345_1 | 1 | 45 | 5 | 284 | 27 |
| 42287 | 346_1 | 0.2 | 66 | 7 | 144 | 32 |
| 42287 | 346_1 | 1 | 53 | 5 | 279 | 34 |
| 42289 | 347_1 | 0.2 | 75 | 20 | 125 | 10 |
| 42289 | 347_1 | 1 | 68 | 7 | 241 | 69 |
| 43452 | 348_1 | 0.2 | 62 | 12 | 231 | 92 |
| 43452 | 348_1 | 1 | 48 | 23 | 257 | 72 |
| 43453 | 349_1 | 0.2 | 52 | 11 | 142 | 41 |
| 43453 | 349_1 | 1 | 44 | 23 | 257 | 34 |
| 43562 | 350_1 | 0.2 | 50 | 13 | 148 | 35 |
| 43562 | 350_1 | 1 | 36 | 10 | NA | NA |
| 43565 | 351_1 | 0.2 | 71 | 10 | 116 | 43 |
| 43565 | 351_1 | 1 | 60 | 11 | 154 | 37 |
| 43566 | 352_1 | 0.2 | 65 | 19 | 139 | 14 |
| 43566 | 352_1 | 1 | 44 | 8 | 255 | 23 |
| 43634 | 353_1 | 0.2 | 63 | 25 | 172 | 75 |
| 43634 | 353_1 | 1 | 51 | 22 | 214 | NA |
| 44180 | 355_1 | 0.2 | 60 | 6 | 165 | 8 |
| 44180 | 355_1 | 1 | 57 | 25 | 145 | NA |
| 44180 | 354_1 | 0.2 | 76 | 17 | 149 | 55 |

TABLE 6-continued

Oligonucleotide activity in patient derived human neuronal cell cultures.

| Start SEQ ID NO 1 | CMP ID NO | Conc µM | % of Mock UBE3A-SUP | sd | % of Mock UBE3A | sd |
|---|---|---|---|---|---|---|
| 44180 | 354_1 | 1 | 48 | 10 | 240 | 29 |
| 44181 | 356_1 | 0.2 | 60 | 5 | 170 | 27 |
| 44181 | 356_1 | 1 | 43 | 15 | 154 | 55 |
| 44183 | 357_1 | 0.2 | 50 | 15 | 214 | 33 |
| 44183 | 357_1 | 1 | 37 | 17 | 196 | 19 |
| 44184 | 358_1 | 0.2 | 57 | 5 | 155 | 31 |
| 44184 | 358_1 | 1 | 47 | 10 | 257 | 94 |
| 44439 | 359_1 | 0.2 | 46 | 4 | 220 | 53 |
| 44439 | 359_1 | 1 | 45 | 2 | 347 | 52 |
| 44440 | 360_1 | 0.2 | 48 | 9 | 261 | 37 |
| 44440 | 360_1 | 1 | 44 | 6 | NA | NA |
| 44440 | 361_1 | 0.2 | 43 | 5 | 218 | 46 |
| 44440 | 361_1 | 1 | 29 | 3 | 291 | 19 |
| 44441 | 362_1 | 0.2 | 50 | 5 | 192 | 60 |
| 44441 | 362_1 | 1 | 45 | 7 | 290 | 58 |
| 44441 | 363_1 | 0.2 | 45 | 10 | 185 | 51 |
| 44441 | 363_1 | 1 | 43 | 10 | 247 | NA |
| 44442 | 364_1 | 0.2 | 54 | 8 | 124 | 24 |
| 44442 | 364_1 | 1 | 39 | 5 | 271 | 54 |
| 44442 | 365_1 | 0.2 | 59 | 6 | 166 | 9 |
| 44442 | 365_1 | 1 | 44 | 8 | 313 | 47 |
| 44443 | 367_1 | 0.2 | 55 | 10 | 161 | 29 |
| 44443 | 367_1 | 1 | 40 | 7 | 314 | 67 |
| 44443 | 366_1 | 0.2 | 51 | 5 | 202 | 44 |
| 44443 | 366_1 | 1 | 41 | 10 | 300 | 31 |
| 44477 | 368_1 | 0.2 | 73 | 6 | 155 | 58 |
| 44477 | 368_1 | 1 | 52 | 3 | 362 | 141 |
| 44478 | 369_1 | 0.2 | 82 | 18 | 130 | 35 |
| 44478 | 369_1 | 1 | 58 | 11 | 228 | 66 |
| 44776 | 370_1 | 0.2 | 60 | 7 | 128 | 20 |
| 44776 | 370_1 | 1 | 46 | 5 | 274 | NA |
| 45216 | 371_1 | 0.2 | 50 | 10 | 149 | 33 |
| 45216 | 371_1 | 1 | 41 | 8 | 260 | 59 |
| 45217 | 372_1 | 0.2 | 59 | 7 | 132 | 45 |
| 45217 | 372_1 | 1 | 39 | 4 | 270 | 12 |
| 45217 | 373_1 | 0.2 | 47 | 3 | 167 | 52 |
| 45217 | 373_1 | 1 | 38 | 4 | 330 | 62 |
| 45218 | 374_1 | 0.2 | 51 | 9 | 189 | 27 |
| 45218 | 374_1 | 1 | 42 | 9 | 359 | 93 |
| 45246 | 375_1 | 0.2 | 61 | 8 | 175 | 29 |
| 45246 | 375_1 | 1 | 50 | 7 | 257 | NA |
| 45247 | 376_1 | 0.2 | 84 | 4 | 116 | 40 |
| 45247 | 376_1 | 1 | 74 | 10 | 144 | NA |
| 45248 | 378_1 | 0.2 | 61 | 10 | 226 | 2 |
| 45248 | 378_1 | 1 | 50 | 5 | 367 | 141 |
| 45248 | 377_1 | 0.2 | 74 | 11 | 138 | 29 |
| 45248 | 377_1 | 1 | 62 | 4 | 251 | NA |
| 45249 | 379_1 | 0.2 | 48 | 5 | 232 | NA |
| 45249 | 379_1 | 1 | 50 | NA | 312 | NA |
| 45249 | 380_1 | 0.2 | 54 | 4 | 203 | 16 |
| 45249 | 380_1 | 1 | 53 | 1 | 353 | 12 |
| 45250 | 381_1 | 0.2 | 48 | 6 | 230 | 25 |
| 45250 | 381_1 | 1 | 40 | 7 | 387 | 79 |
| 45250 | 382_1 | 0.2 | 60 | 7 | 153 | 30 |
| 45250 | 382_1 | 1 | 46 | 3 | 288 | 43 |
| 45258 | 383_1 | 0.2 | 46 | 4 | 211 | NA |
| 45258 | 383_1 | 1 | 34 | 6 | 307 | 29 |
| 45266 | 385_1 | 0.2 | 80 | 34 | 85 | 8 |
| 45266 | 385_1 | 1 | 55 | 13 | 128 | 25 |
| 45266 | 384_1 | 0.2 | 92 | 4 | 128 | 50 |
| 45266 | 384_1 | 1 | 79 | 12 | 108 | 23 |
| 45267 | 386_1 | 0.2 | 93 | 23 | 105 | 13 |
| 45267 | 386_1 | 1 | 80 | 23 | 139 | 14 |
| 45268 | 387_1 | 0.2 | 90 | 17 | 111 | 1 |
| 45268 | 387_1 | 1 | 109 | 9 | 122 | 44 |
| 45270 | 388_1 | 0.2 | 97 | 7 | 146 | 47 |
| 45270 | 388_1 | 1 | 88 | 9 | 113 | 22 |
| 45271 | 390_1 | 0.2 | 79 | 12 | 141 | 14 |
| 45271 | 390_1 | 1 | 58 | 14 | 197 | 38 |
| 45271 | 389_1 | 0.2 | 70 | 3 | 97 | 28 |
| 45271 | 389_1 | 1 | 53 | 6 | 150 | 26 |
| 45272 | 391_1 | 0.2 | 61 | 4 | 128 | 24 |
| 45272 | 391_1 | 1 | 55 | 14 | 208 | 39 |
| 45560 | 392_1 | 0.2 | 86 | 22 | 97 | 26 |
| 45560 | 392_1 | 1 | 71 | 19 | 125 | 18 |
| 45627 | 393_1 | 0.2 | 48 | 14 | 150 | 64 |
| 45627 | 393_1 | 1 | 39 | 1 | 209 | 35 |
| 45628 | 394_1 | 0.2 | 51 | 4 | 174 | 34 |
| 45628 | 394_1 | 1 | 44 | 8 | 309 | 30 |
| 45629 | 395_1 | 0.2 | 60 | 5 | 151 | 24 |
| 45629 | 395_1 | 1 | 48 | 7 | 297 | 43 |
| 45629 | 396_1 | 0.2 | 86 | 24 | 139 | 55 |
| 45629 | 396_1 | 1 | 64 | 13 | 203 | 38 |
| 45635 | 397_1 | 0.2 | 50 | 10 | 289 | 61 |
| 45635 | 397_1 | 1 | 46 | 2 | 401 | 56 |
| 45709 | 398_1 | 0.2 | 47 | 6 | 207 | 61 |
| 45709 | 398_1 | 1 | 49 | 6 | 233 | NA |
| 45709 | 399_1 | 0.2 | 56 | 6 | 206 | 13 |
| 45709 | 399_1 | 1 | 45 | 4 | 287 | 93 |
| 46215 | 400_1 | 0.2 | 78 | 14 | 122 | 13 |
| 46215 | 400_1 | 1 | 60 | 9 | 114 | 19 |
| 46256 | 401_1 | 0.2 | 62 | 7 | 164 | 56 |
| 46256 | 401_1 | 1 | 45 | 5 | 213 | 20 |
| 46257 | 404_1 | 0.2 | 44 | 4 | 207 | 44 |
| 46257 | 404_1 | 1 | 41 | 3 | 288 | 45 |
| 46257 | 402_1 | 0.2 | 48 | 5 | 197 | 57 |
| 46257 | 402_1 | 1 | 41 | 1 | 300 | 11 |
| 46257 | 403_1 | 0.2 | 51 | 4 | 265 | 50 |
| 46257 | 403_1 | 1 | 44 | 5 | 382 | NA |
| 46259 | 405_1 | 0.2 | 46 | 4 | NA | NA |
| 46259 | 405_1 | 1 | 39 | 10 | 359 | 10 |
| 46260 | 406_1 | 0.2 | 52 | 9 | 153 | 63 |
| 46260 | 406_1 | 1 | 48 | 7 | 262 | 71 |
| 46263 | 407_1 | 0.2 | 52 | 9 | 148 | 9 |
| 46263 | 407_1 | 1 | 41 | 5 | 262 | 45 |
| 46264 | 408_1 | 0.2 | 51 | 17 | 269 | 72 |
| 46264 | 408_1 | 1 | 42 | 8 | 280 | 55 |
| 46392 | 409_1 | 0.2 | 38 | 10 | 359 | 91 |
| 46392 | 409_1 | 1 | 38 | 8 | NA | NA |
| 46393 | 410_1 | 0.2 | 39 | 12 | 295 | 30 |
| 46393 | 410_1 | 1 | 32 | 12 | NA | NA |
| 46420 | 411_1 | 0.2 | 75 | 10 | 69 | 3 |
| 46420 | 411_1 | 1 | 86 | 3 | 101 | 21 |
| 46505 | 412_1 | 0.2 | 65 | 11 | 97 | 7 |
| 46505 | 412_1 | 1 | 53 | 5 | 226 | 59 |
| 46505 | 413_1 | 0.2 | 74 | 16 | 124 | 19 |
| 46505 | 413_1 | 1 | 69 | 13 | 117 | 11 |
| 46506 | 414_1 | 0.2 | 75 | 7 | 149 | 17 |
| 46506 | 414_1 | 1 | 71 | 10 | 169 | 118 |
| 46507 | 415_1 | 0.2 | 86 | 31 | 119 | 36 |
| 46507 | 415_1 | 1 | 66 | 17 | 129 | 28 |
| 46508 | 416_1 | 0.2 | 86 | 22 | 87 | 22 |
| 46508 | 416_1 | 1 | 67 | 10 | 142 | 16 |
| 47364 | 417_1 | 0.2 | 49 | 2 | 166 | 22 |
| 47364 | 417_1 | 1 | 47 | 13 | 295 | NA |
| 47365 | 418_1 | 0.2 | 54 | 3 | 131 | 29 |
| 47365 | 418_1 | 1 | 41 | 3 | 230 | 42 |
| 48110 | 419_1 | 0.2 | 77 | 9 | 101 | 45 |
| 48110 | 419_1 | 1 | 58 | 8 | 178 | 68 |
| 48111 | 420_1 | 0.2 | 63 | 7 | 121 | 32 |
| 48111 | 420_1 | 1 | 51 | 2 | 238 | 59 |
| 48186 | 421_1 | 0.2 | 69 | 5 | 176 | 52 |
| 48186 | 421_1 | 1 | 44 | 12 | 307 | 62 |
| 48221 | 422_1 | 0.2 | 58 | 15 | 149 | 63 |
| 48221 | 422_1 | 1 | 39 | 6 | 235 | 50 |
| 48222 | 423_1 | 0.2 | 60 | 12 | 143 | 9 |
| 48222 | 423_1 | 1 | 43 | 10 | 209 | 57 |
| 49345 | 85_2 | 0.2 | 43 | 14 | 242 | 38 |
| 49345 | 85_2 | 1 | 37 | 5 | 275 | NA |
| 50282 | 424_1 | 0.2 | 75 | 20 | 138 | 19 |
| 50282 | 424_1 | 1 | 56 | 9 | 226 | 62 |
| 51241 | 426_1 | 0.2 | 61 | 6 | 144 | NA |
| 51241 | 426_1 | 1 | 46 | 9 | 264 | 44 |
| 51241 | 425_1 | 0.2 | 46 | 8 | 164 | 22 |
| 51241 | 425_1 | 1 | 44 | 4 | 244 | 35 |
| 51242 | 428_1 | 0.2 | 57 | 6 | 138 | 30 |
| 51242 | 428_1 | 1 | 48 | 7 | 290 | 39 |
| 51242 | 427_1 | 0.2 | 40 | 15 | 341 | NA |
| 51242 | 427_1 | 1 | 30 | 8 | 286 | 63 |
| 51244 | 429_1 | 0.2 | 46 | 5 | 184 | 25 |

TABLE 6-continued

Oligonucleotide activity in patient derived human neuronal cell cultures.

| Start SEQ ID NO 1 | CMP ID NO | Conc μM | % of Mock UBE3A-SUP | sd | % of Mock UBE3A | sd |
|---|---|---|---|---|---|---|
| 51244 | 429_1 | 1 | 44 | 6 | 283 | 4 |
| 51245 | 430_1 | 0.2 | 47 | 7 | 203 | 9 |
| 51245 | 430_1 | 1 | 37 | 5 | 271 | 29 |
| 51358 | 431_1 | 0.2 | 51 | 7 | 265 | 10 |
| 51358 | 431_1 | 1 | 40 | 4 | 363 | 70 |
| 51358 | 432_1 | 0.2 | 60 | 4 | 202 | 51 |
| 51358 | 432_1 | 1 | 37 | 7 | 275 | NA |
| 51359 | 433_1 | 0.2 | 40 | 3 | 238 | 20 |
| 51359 | 433_1 | 1 | 32 | 3 | NA | NA |
| 51359 | 434_1 | 0.2 | 39 | 6 | 424 | 83 |
| 51359 | 434_1 | 1 | 35 | 6 | 360 | NA |
| 51438 | 435_1 | 0.2 | 78 | 15 | 144 | 62 |
| 51438 | 435_1 | 1 | 60 | 14 | 201 | 27 |
| 51438 | 436_1 | 0.2 | 71 | 4 | 125 | 32 |
| 51438 | 436_1 | 1 | 54 | 6 | 205 | 71 |
| 51953 | 437_1 | 0.2 | 46 | 6 | 217 | 35 |
| 51953 | 437_1 | 1 | 37 | 4 | 277 | 52 |
| 52150 | 438_1 | 0.2 | 67 | 6 | 131 | 39 |
| 52150 | 438_1 | 1 | 53 | 13 | 177 | NA |
| 52549 | 439_1 | 0.2 | 56 | 5 | 162 | 31 |
| 52549 | 439_1 | 1 | 50 | 10 | 215 | 39 |
| 52550 | 440_1 | 0.2 | 69 | 13 | 137 | 40 |
| 52550 | 440_1 | 1 | 50 | 5 | 156 | 53 |
| 52551 | 441_1 | 0.2 | 66 | 3 | 132 | 8 |
| 52551 | 441_1 | 1 | 49 | 5 | 169 | 27 |
| 52579 | 442_1 | 0.2 | 38 | 7 | 280 | 60 |
| 52579 | 442_1 | 1 | 37 | 5 | 257 | 51 |
| 53012 | 443_1 | 0.2 | 79 | 10 | 197 | 61 |
| 53012 | 443_1 | 1 | 65 | 7 | 212 | 36 |
| 53013 | 445_1 | 0.2 | 64 | 6 | 211 | 13 |
| 53013 | 445_1 | 1 | 56 | 4 | 264 | 42 |
| 53013 | 444_1 | 0.2 | 68 | 11 | 137 | 33 |
| 53013 | 444_1 | 1 | 58 | 9 | 198 | 35 |
| 53014 | 446_1 | 0.2 | 59 | 6 | 125 | NA |
| 53014 | 446_1 | 1 | 47 | 3 | 216 | 22 |
| 53014 | 447_1 | 0.2 | 53 | 2 | 188 | 94 |
| 53014 | 447_1 | 1 | 51 | 10 | 192 | 47 |
| 54198 | 448_1 | 0.2 | 54 | 15 | 161 | 66 |
| 54198 | 448_1 | 1 | 48 | 11 | 243 | NA |
| 54199 | 449_1 | 0.2 | 63 | 12 | 166 | 20 |
| 54199 | 449_1 | 1 | 45 | 8 | 185 | 41 |
| 54232 | 450_1 | 0.2 | 84 | 17 | 112 | 67 |
| 54232 | 450_1 | 1 | 83 | 8 | 157 | 15 |
| 54233 | 451_1 | 0.2 | 67 | 14 | 118 | 44 |
| 54233 | 451_1 | 1 | 51 | 8 | 192 | 34 |
| 54235 | 452_1 | 0.2 | 50 | 3 | 162 | NA |
| 54235 | 452_1 | 1 | 42 | 7 | 190 | NA |
| 54236 | 453_1 | 0.2 | 47 | 21 | 234 | 17 |
| 54236 | 453_1 | 1 | 42 | 5 | 295 | NA |
| 54238 | 454_1 | 0.2 | 76 | 14 | 85 | NA |
| 54238 | 454_1 | 1 | 48 | 12 | 162 | NA |
| 54239 | 455_1 | 0.2 | 62 | 6 | 132 | 69 |
| 54239 | 455_1 | 1 | 46 | 7 | 149 | 57 |
| 54609 | 456_1 | 0.2 | 66 | 10 | 130 | 57 |
| 54609 | 456_1 | 1 | 56 | 11 | 141 | 60 |
| 54924 | 457_1 | 0.2 | 78 | 3 | 137 | 29 |
| 54924 | 457_1 | 1 | 61 | 4 | 178 | 25 |

Example 4—Activity of Oligonucleotides Targeting the SNHG14 Transcript in the Region Antisense to the UBE3A Pre-mRNA Oligonucleotides targeting position 55337-136214 of SEQ ID NO: 1 were tested in patient derived human neuronal cell cultures (see protocol in "Materials and methods" section). The oligonucleotides ability to reduce the SNHG14 transcript in the region downstream of SNORD109B (also termed UBE3A suppressor or UBE3A-SUP in the data table). Furthermore, the ability to induce UBE3A mRNA re-expression was analyzed.

The oligonucleotides were screened according to the protocol for screening oligonucleotides in human neuronal cell cultures described in the section "Materials and methods"—"Screening oligonucleotides in human neuronal cell cultures—96 well system".

The results are shown in table 7.

TABLE 7

Oligonucleotide activity in patient derived human neuronal cell cultures.

| Start SEQ ID NO 1 | CMP ID NO | Conc μM | % of Mock UBE3A-SUP | sd | % of Mock UBE3A | sd |
|---|---|---|---|---|---|---|
| 55337 | 458_1 | 0.2 | 64 | 0 | 177 | 6 |
| 55337 | 458_1 | 1 | 50 | 10 | 233 | 9 |
| 55338 | 459_1 | 0.2 | 48 | 1 | 186 | 6 |
| 55338 | 459_1 | 1 | 44 | 9 | 213 | NA |
| 59565 | 460_1 | 0.2 | 66 | 4 | 110 | 24 |
| 59565 | 460_1 | 1 | 66 | 9 | 131 | 23 |
| 59574 | 461_1 | 0.2 | 56 | 5 | 162 | 19 |
| 59574 | 461_1 | 1 | 45 | 13 | 149 | 6 |
| 59575 | 462_1 | 0.2 | 56 | 7 | 114 | 84 |
| 59575 | 462_1 | 1 | 39 | 11 | 101 | 13 |
| 59576 | 463_1 | 0.2 | 82 | 19 | 52 | NA |
| 59576 | 463_1 | 1 | 65 | 15 | 95 | 18 |
| 60012 | 464_1 | 0.2 | 47 | 5 | 129 | 71 |
| 60012 | 464_1 | 1 | 41 | 3 | 160 | 64 |
| 60298 | 465_1 | 0.2 | 49 | 7 | 206 | 95 |
| 60298 | 465_1 | 1 | 37 | 9 | 222 | 44 |
| 60448 | 466_1 | 0.2 | 47 | 7 | 130 | NA |
| 60448 | 466_1 | 1 | 33 | 8 | 167 | 31 |
| 60821 | 467_1 | 0.2 | 87 | 1 | 73 | NA |
| 60821 | 467_1 | 1 | 62 | 18 | 101 | 3 |
| 61925 | 468_1 | 0.2 | 108 | 19 | 105 | 19 |
| 61925 | 468_1 | 1 | 95 | 17 | 101 | 19 |
| 62287 | 469_1 | 0.2 | 62 | 8 | 180 | 57 |
| 62287 | 469_1 | 1 | 48 | 5 | 196 | 38 |
| 62422 | 470_1 | 0.2 | 71 | 2 | 130 | 20 |
| 62422 | 470_1 | 1 | 57 | 9 | 116 | 18 |
| 62443 | 471_1 | 0.2 | 51 | 2 | NA | NA |
| 62443 | 471_1 | 1 | 43 | 2 | 160 | 34 |
| 64113 | 472_1 | 0.2 | 95 | 4 | 83 | 22 |
| 64113 | 472_1 | 1 | 76 | 14 | 74 | 36 |
| 64461 | 473_1 | 0.2 | 79 | 23 | 141 | 22 |
| 64461 | 473_1 | 1 | 59 | 12 | 279 | 53 |
| 64462 | 474_1 | 0.2 | 80 | 12 | 138 | 3 |
| 64462 | 474_1 | 1 | 84 | 15 | 202 | 3 |
| 65272 | 475_1 | 0.2 | 77 | 3 | 104 | 2 |
| 65272 | 475_1 | 1 | 75 | 23 | 113 | 10 |
| 66840 | 476_1 | 0.2 | 67 | 5 | 86 | 5 |
| 66840 | 476_1 | 1 | 72 | 10 | 100 | 12 |
| 67426 | 477_1 | 0.2 | 62 | 15 | 101 | 8 |
| 67426 | 477_1 | 1 | 65 | 13 | 170 | 52 |
| 68194 | 478_1 | 0.2 | 53 | 10 | 109 | 6 |
| 68194 | 478_1 | 1 | 59 | 4 | 178 | 7 |
| 68328 | 479_1 | 0.2 | 74 | 6 | 94 | 2 |
| 68328 | 479_1 | 1 | 79 | 16 | 111 | 38 |
| 68805 | 480_1 | 0.2 | 58 | 15 | 157 | 63 |
| 68805 | 480_1 | 1 | 49 | 2 | 190 | 26 |
| 68921 | 481_1 | 0.2 | 58 | 7 | 210 | 58 |
| 68921 | 481_1 | 1 | 55 | 10 | 281 | NA |
| 70133 | 482_1 | 0.2 | 50 | 9 | 149 | 6 |
| 70133 | 482_1 | 1 | 54 | 8 | 247 | 41 |
| 72377 | 483_1 | 0.2 | 44 | 2 | 143 | NA |
| 72377 | 483_1 | 1 | 52 | 6 | 195 | 37 |
| 72378 | 484_1 | 0.2 | 47 | 12 | 111 | 8 |
| 72378 | 484_1 | 1 | 56 | 3 | 201 | NA |
| 72826 | 485_1 | 0.2 | 54 | 12 | 116 | 0 |
| 72826 | 485_1 | 1 | 64 | 13 | 172 | 1 |
| 72861 | 486_1 | 0.2 | 52 | 9 | 93 | 6 |
| 72861 | 486_1 | 1 | 54 | 6 | 167 | 16 |
| 72887 | 487_1 | 0.2 | 55 | 3 | 128 | 5 |
| 72887 | 487_1 | 1 | 59 | 4 | 193 | 24 |
| 73474 | 488_1 | 0.2 | 55 | 10 | 132 | 20 |
| 73474 | 488_1 | 1 | 55 | 5 | 202 | 56 |
| 73992 | 489_1 | 0.2 | 60 | 7 | 146 | 17 |
| 73992 | 489_1 | 1 | 67 | 7 | 197 | 31 |
| 74791 | 490_1 | 0.2 | 42 | 5 | 167 | 65 |
| 74791 | 490_1 | 1 | 46 | 6 | 277 | 19 |

TABLE 7-continued

Oligonucleotide activity in patient derived human neuronal cell cultures.

| Start SEQ ID NO 1 | CMP ID NO | Conc μM | % of Mock UBE3A-SUP | sd | % of Mock UBE3A | sd |
|---|---|---|---|---|---|---|
| 74851 | 491_1 | 0.2 | 69 | 14 | 78 | 1 |
| 74851 | 491_1 | 1 | 73 | 6 | 114 | 11 |
| 74853 | 492_1 | 0.2 | 64 | 6 | 84 | 1 |
| 74853 | 492_1 | 1 | 68 | 5 | 136 | 25 |
| 75840 | 493_1 | 0.2 | 40 | 10 | 90 | 6 |
| 75840 | 493_1 | 1 | 61 | 8 | 155 | 32 |
| 75841 | 494_1 | 0.2 | 65 | 10 | 131 | 30 |
| 75841 | 494_1 | 1 | 57 | 4 | 119 | 16 |
| 76238 | 495_1 | 0.2 | 70 | 9 | 109 | 41 |
| 76238 | 495_1 | 1 | 50 | 8 | 156 | 22 |
| 76254 | 496_1 | 0.2 | 67 | 13 | 134 | 34 |
| 76254 | 496_1 | 1 | 55 | 7 | 201 | NA |
| 76811 | 497_1 | 0.2 | 83 | 7 | 134 | 41 |
| 76811 | 497_1 | 1 | 77 | 8 | 148 | 32 |
| 77114 | 498_1 | 0.2 | 59 | 2 | 128 | 13 |
| 77114 | 498_1 | 1 | 64 | 10 | 206 | NA |
| 80468 | 499_1 | 0.2 | 55 | 2 | 105 | 34 |
| 80468 | 499_1 | 1 | 61 | 6 | 151 | 42 |
| 81047 | 500_1 | 0.2 | 103 | 17 | 80 | 6 |
| 81047 | 500_1 | 1 | 143 | 25 | 122 | 7 |
| 82233 | 501_1 | 0.2 | 57 | NA | 104 | NA |
| 82233 | 501_1 | 1 | 61 | 3 | 199 | 39 |
| 84166 | 502_1 | 0.2 | 49 | 6 | 89 | 0 |
| 84166 | 502_1 | 1 | 57 | 5 | 115 | NA |
| 85392 | 503_1 | 0.2 | 61 | 6 | 90 | 14 |
| 85392 | 503_1 | 1 | 62 | 8 | 118 | 15 |
| 86974 | 504_1 | 0.2 | 73 | 7 | 82 | 4 |
| 86974 | 504_1 | 1 | 79 | 3 | 104 | 19 |
| 87728 | 505_1 | 0.2 | 79 | 14 | 76 | 2 |
| 87728 | 505_1 | 1 | 80 | 19 | 97 | 35 |
| 87810 | 506_1 | 0.2 | 69 | 9 | 101 | 20 |
| 87810 | 506_1 | 1 | 73 | 6 | 155 | 2 |
| 88417 | 507_1 | 0.2 | 45 | NA | 116 | 3 |
| 88417 | 507_1 | 1 | 61 | 14 | 168 | 6 |
| 88991 | 508_1 | 0.2 | 51 | 6 | 113 | 20 |
| 88991 | 508_1 | 1 | 59 | 2 | 154 | 31 |
| 90228 | 509_1 | 0.2 | 65 | 6 | 76 | 10 |
| 90228 | 509_1 | 1 | 62 | 7 | 118 | 4 |
| 90474 | 510_1 | 0.2 | 71 | 7 | 83 | 14 |
| 90474 | 510_1 | 1 | 81 | 3 | 125 | NA |
| 91625 | 511_1 | 0.2 | 57 | 17 | 105 | 3 |
| 91625 | 511_1 | 1 | 65 | 11 | 150 | NA |
| 91885 | 512_1 | 0.2 | 57 | 5 | 105 | 1 |
| 91885 | 512_1 | 1 | 66 | 7 | 155 | 30 |
| 92976 | 513_1 | 0.2 | 67 | 6 | 136 | 44 |
| 92976 | 513_1 | 1 | 68 | 11 | 138 | 38 |
| 94304 | 514_1 | 0.2 | 81 | 11 | 110 | 7 |
| 94304 | 514_1 | 1 | 87 | 6 | 153 | 28 |
| 94528 | 515_1 | 0.2 | 48 | 5 | 128 | 6 |
| 94528 | 515_1 | 1 | 55 | 3 | 191 | 25 |
| 95653 | 516_1 | 0.2 | 57 | 3 | 108 | 7 |
| 95653 | 516_1 | 1 | 62 | 3 | 131 | 16 |
| 96751 | 517_1 | 0.2 | 63 | 9 | 90 | 19 |
| 96751 | 517_1 | 1 | 62 | 4 | 106 | NA |
| 97636 | 518_1 | 0.2 | 49 | 5 | 107 | 14 |
| 97636 | 518_1 | 1 | 44 | 9 | 137 | NA |
| 98480 | 519_1 | 0.2 | 55 | 1 | 106 | NA |
| 98480 | 519_1 | 1 | 54 | 5 | 112 | 23 |
| 98481 | 520_1 | 0.2 | 55 | 2 | 116 | 6 |
| 98481 | 520_1 | 1 | 62 | 4 | 129 | 6 |
| 99646 | 521_1 | 0.2 | 74 | 10 | 105 | 1 |
| 99646 | 521_1 | 1 | 87 | 13 | 119 | 27 |
| 100334 | 522_1 | 0.2 | 49 | 7 | 157 | 28 |
| 100334 | 522_1 | 1 | 57 | 2 | 120 | 37 |
| 101110 | 523_1 | 0.2 | 51 | 10 | 96 | 10 |
| 101110 | 523_1 | 1 | 72 | 14 | 114 | 25 |
| 101898 | 524_1 | 0.2 | 85 | 11 | 79 | 3 |
| 101898 | 524_1 | 1 | 93 | 21 | 92 | 46 |
| 102558 | 525_1 | 0.2 | 82 | 9 | 104 | 8 |
| 102558 | 525_1 | 1 | 86 | 18 | 104 | 30 |
| 103589 | 526_1 | 0.2 | 85 | 17 | 114 | 14 |
| 103589 | 526_1 | 1 | 94 | 39 | 126 | 6 |
| 104309 | 527_1 | 0.2 | 63 | 11 | 148 | 2 |
| 104309 | 527_1 | 1 | 70 | 26 | 155 | NA |
| 105686 | 528_1 | 0.2 | 66 | 11 | 91 | 24 |
| 105686 | 528_1 | 1 | 66 | 14 | 140 | 36 |
| 107972 | 529_1 | 0.2 | 84 | 15 | 109 | 15 |
| 107972 | 529_1 | 1 | 94 | 14 | 127 | 24 |
| 108257 | 530_1 | 0.2 | 63 | 7 | 114 | 19 |
| 108257 | 530_1 | 1 | 67 | 12 | 141 | 40 |
| 109407 | 531_1 | 0.2 | 84 | 24 | 87 | 16 |
| 109407 | 531_1 | 1 | 82 | 11 | 127 | 26 |
| 110210 | 532_1 | 0.2 | 72 | 12 | 91 | 14 |
| 110210 | 532_1 | 1 | 80 | 14 | 122 | 40 |
| 110768 | 533_1 | 0.2 | 67 | 8 | 126 | 16 |
| 110768 | 533_1 | 1 | 87 | 21 | 176 | 45 |
| 111811 | 534_1 | 0.2 | 77 | 2 | 98 | 17 |
| 111811 | 534_1 | 1 | 74 | 6 | 143 | 14 |
| 111812 | 535_1 | 0.2 | 64 | 4 | 97 | 0 |
| 111812 | 535_1 | 1 | 77 | 3 | 136 | 37 |
| 112149 | 536_1 | 0.2 | 73 | 2 | 63 | 2 |
| 112149 | 536_1 | 1 | 77 | 18 | 127 | 36 |
| 112150 | 537_1 | 0.2 | 76 | 6 | 78 | 8 |
| 112150 | 537_1 | 1 | 90 | 29 | 91 | 11 |
| 112945 | 538_1 | 0.2 | 69 | 4 | 121 | 2 |
| 112945 | 538_1 | 1 | 83 | 14 | 102 | 39 |
| 113533 | 539_1 | 0.2 | 95 | 17 | 85 | 2 |
| 113533 | 539_1 | 1 | 91 | 27 | 87 | 17 |
| 114274 | 540_1 | 0.2 | 89 | 11 | 103 | 17 |
| 114274 | 540_1 | 1 | 87 | 26 | 132 | 20 |
| 114495 | 541_1 | 0.2 | 76 | 5 | 88 | 1 |
| 114495 | 541_1 | 1 | 83 | 15 | 120 | 6 |
| 114831 | 542_1 | 0.2 | 59 | 3 | 76 | 4 |
| 114831 | 542_1 | 1 | 74 | 3 | 104 | 4 |
| 115355 | 543_1 | 0.2 | 66 | 8 | 91 | 9 |
| 115355 | 543_1 | 1 | 74 | 16 | 110 | NA |
| 116105 | 544_1 | 0.2 | 55 | 12 | 77 | NA |
| 116105 | 544_1 | 1 | 74 | 6 | 110 | 8 |
| 116106 | 545_1 | 0.2 | 58 | 18 | 96 | 9 |
| 116106 | 545_1 | 1 | 66 | 8 | 130 | 10 |
| 117096 | 546_1 | 0.2 | 69 | 9 | 118 | 20 |
| 117096 | 546_1 | 1 | 65 | 4 | 146 | NA |
| 117189 | 547_1 | 0.2 | 69 | 6 | 98 | 9 |
| 117189 | 547_1 | 1 | 74 | 11 | 146 | 25 |
| 117476 | 548_1 | 0.2 | 59 | 4 | 87 | 5 |
| 117476 | 548_1 | 1 | 65 | 3 | 104 | 10 |
| 118293 | 549_1 | 0.2 | 55 | 8 | 92 | 3 |
| 118293 | 549_1 | 1 | 66 | 10 | 105 | 24 |
| 118294 | 550_1 | 0.2 | 55 | 18 | 90 | 4 |
| 118294 | 550_1 | 1 | 72 | 21 | 119 | 5 |
| 118756 | 551_1 | 0.2 | 60 | 13 | 86 | 18 |
| 118756 | 551_1 | 1 | 88 | 24 | 120 | 26 |
| 119621 | 552_1 | 0.2 | 77 | 21 | 117 | 4 |
| 119621 | 552_1 | 1 | 102 | 19 | 146 | NA |
| 120655 | 553_1 | 0.2 | 55 | 9 | 124 | 19 |
| 120655 | 553_1 | 1 | 57 | 7 | 185 | 14 |
| 123733 | 554_1 | 0.2 | 74 | 6 | 87 | 14 |
| 123733 | 554_1 | 1 | 77 | 4 | 127 | 4 |
| 124163 | 555_1 | 0.2 | 89 | 12 | 117 | 46 |
| 124163 | 555_1 | 1 | 67 | 20 | 152 | 13 |
| 125512 | 556_1 | 0.2 | 70 | 5 | 114 | 26 |
| 125512 | 556_1 | 1 | 69 | 11 | 119 | 47 |
| 126882 | 557_1 | 0.2 | 78 | 15 | 106 | 8 |
| 126882 | 557_1 | 1 | 84 | 10 | 113 | 33 |
| 127105 | 558_1 | 0.2 | 71 | 7 | 91 | 13 |
| 127105 | 558_1 | 1 | 68 | 5 | 108 | 28 |
| 127809 | 559_1 | 0.2 | 59 | 4 | 74 | NA |
| 127809 | 559_1 | 1 | 58 | 7 | 101 | 26 |
| 129020 | 560_1 | 0.2 | 82 | 11 | 103 | 39 |
| 129020 | 560_1 | 1 | 77 | 9 | 103 | 27 |
| 129205 | 561_1 | 0.2 | 75 | 24 | 78 | 16 |
| 129205 | 561_1 | 1 | 89 | 11 | 102 | 23 |
| 129928 | 562_1 | 0.2 | 57 | 0 | 98 | 21 |
| 129928 | 562_1 | 1 | 63 | 9 | 107 | 18 |
| 130020 | 563_1 | 0.2 | 65 | 5 | 85 | 9 |
| 130020 | 563_1 | 1 | 65 | 3 | 145 | 12 |
| 130884 | 564_1 | 0.2 | 81 | 24 | 117 | 31 |
| 130884 | 564_1 | 1 | 83 | 4 | 139 | 17 |
| 130886 | 565_1 | 0.2 | 80 | 8 | 103 | 13 |
| 130886 | 565_1 | 1 | 69 | 7 | 122 | 11 |

TABLE 7-continued

Oligonucleotide activity in patient derived human neuronal cell cultures.

| Start SEQ ID NO 1 | CMP ID NO | Conc μM | % of Mock UBE3A-SUP | sd | % of Mock UBE3A | sd |
|---|---|---|---|---|---|---|
| 131404 | 566_1 | 0.2 | 79 | 4 | 85 | 3 |
| 131404 | 566_1 | 1 | 80 | 7 | 116 | 24 |
| 132514 | 567_1 | 0.2 | 71 | 8 | 98 | 28 |
| 132514 | 567_1 | 1 | 69 | 9 | 97 | 29 |
| 133367 | 568_1 | 0.2 | 78 | 9 | 88 | 16 |
| 133367 | 568_1 | 1 | 91 | 17 | 88 | 32 |
| 136198 | 569_1 | 0.2 | 88 | 5 | 87 | 2 |
| 136198 | 569_1 | 1 | 81 | 6 | 109 | 35 |

Example 5—Activity of Oligonucleotides Targeting the SNHG14 Transcript in the Region Downstream of SNORD109B and Upstream of the Region Antisense to the UBE3A Pre-mRNA Oligonucleotides targeting position 5224-51257 of SEQ ID NO: 1 were tested in patient derived human neuronal cell cultures (see protocol in "Materials and methods" section). The oligonucleotides ability to reduce the SNHG14 transcript in the region downstream of SNORD109B (also termed UBE3A suppressor or UBE3A-SUP in the data table. Furthermore, the ability to induce UBE3A mRNA re-expression was analyzed.

The oligonucleotides were screened according to the protocol for screening oligonucleotides in human neuronal cell cultures described in the section "Materials and methods" "Screening oligonucleotides in human neuronal cell cultures—96 well system" with the following modifications:
UBE3a-Sense Primer Using commercially available primers and probe from ThermoFisher: Hs00166580_m1 amplifying a 94 bp sequence in position 838 of refseq ID NM_000462.3.

Each plate include PBS controls (instead on a non-targeting ologinucleotide) and a positive control oligonucleotide CMP ID NO: 271_1, resulting in up-regulation of UBE3A mRNA. The additional control oligonucleotides were not included.

Data are presented as average % expression relative to PBS controls across all plates and normalized to the positive control oligonucleotide to manage plate to plate variation in efficacy levels. The results are shown in table 8.

TABLE 8

Oligonucleotide activity in patient derived human neuronal cell cultures.

| Start SEQ ID NO 1 | CMP ID NO | Conc μM | % of Mock UBE3A-SUP | sd | % of Mock UBE3A | sd |
|---|---|---|---|---|---|---|
| 5224 | 169_2 | 7.5 μM | 49 | 4 | 209 | 9 |
| 5224 | 169_3 | 7.5 μM | 47 | 5 | 282 | 5 |
| 5224 | 169_4 | 7.5 μM | 57 | 14 | 202 | 12 |
| 5224 | 169_5 | 7.5 μM | 84 | 36 | 148 | 4 |
| 5224 | 169_6 | 7.5 μM | 42 | 1 | 285 | 16 |
| 5224 | 169_7 | 7.5 μM | 52 | 6 | 233 | 27 |
| 5224 | 169_8 | 7.5 μM | 51 | 7 | 278 | 11 |
| 5224 | 169_9 | 7.5 μM | 51 | 4 | 228 | 20 |
| 5224 | 169_10 | 7.5 μM | 78 | 17 | 143 | 5 |
| 5224 | 169_11 | 7.5 μM | 74 | 15 | 146 | 2 |
| 5224 | 169_12 | 7.5 μM | 47 | 1 | 277 | 26 |
| 5224 | 169_13 | 7.5 μM | 56 | 23 | 244 | 42 |
| 5224 | 169_14 | 7.5 μM | 74 | 16 | 141 | 1 |
| 5224 | 169_15 | 7.5 μM | 95 | 32 | 122 | 13 |
| 5224 | 169_16 | 7.5 μM | 44 | 4 | 276 | 23 |
| 5224 | 169_17 | 7.5 μM | 85 | 5 | 118 | 5 |
| 5224 | 169_18 | 7.5 μM | 75 | 18 | 131 | 4 |
| 5224 | 169_19 | 7.5 μM | 95 | 18 | 126 | 11 |
| 5224 | 169_20 | 7.5 μM | 61 | 12 | 169 | 20 |
| 5224 | 169_21 | 7.5 μM | 79 | 18 | 156 | 3 |
| 5224 | 169_22 | 7.5 μM | 63 | 14 | 173 | 16 |
| 5224 | 169_23 | 7.5 μM | 43 | 2 | 233 | 27 |
| 5224 | 169_24 | 7.5 μM | 56 | 1 | 183 | 9 |
| 5224 | 169_25 | 7.5 μM | 48 | 0 | 220 | 24 |
| 5224 | 169_26 | 7.5 μM | 41 | 1 | 244 | 39 |
| 5224 | 169_27 | 7.5 μM | 55 | 16 | 260 | 42 |
| 5224 | 169_28 | 7.5 μM | 48 | 1 | 265 | 65 |
| 5224 | 169_29 | 7.5 μM | 56 | 2 | 197 | 18 |
| 5224 | 169_30 | 7.5 μM | 57 | 12 | 189 | 12 |
| 5224 | 169_31 | 7.5 μM | 53 | 4 | 196 | 9 |
| 5224 | 169_32 | 7.5 μM | 50 | 1 | 220 | 3 |
| 5224 | 169_33 | 7.5 μM | 64 | 19 | 227 | 8 |
| 5224 | 169_34 | 7.5 μM | 58 | 4 | 193 | 10 |
| 5224 | 169_35 | 7.5 μM | 45 | 2 | 229 | 3 |
| 5224 | 169_36 | 7.5 μM | 44 | 6 | 262 | 14 |
| 5224 | 169_37 | 7.5 μM | 55 | 2 | 180 | 21 |
| 5224 | 169_38 | 7.5 μM | 75 | 22 | 158 | 13 |
| 5224 | 169_39 | 7.5 μM | 76 | 15 | 159 | 17 |
| 5224 | 169_40 | 7.5 μM | 60 | 18 | 232 | 31 |
| 5224 | 169_41 | 7.5 μM | 46 | 3 | 230 | 10 |
| 5224 | 169_42 | 7.5 μM | 47 | 3 | 240 | 11 |
| 5224 | 169_43 | 7.5 μM | 48 | 9 | 273 | 30 |
| 5224 | 169_44 | 7.5 μM | 83 | 32 | 196 | 11 |
| 5224 | 169_45 | 7.5 μM | 69 | 4 | 185 | 20 |
| 5224 | 169_46 | 7.5 μM | 45 | 9 | 256 | 3 |
| 5224 | 169_47 | 7.5 μM | 41 | 2 | 304 | 4 |
| 5224 | 169_48 | 7.5 μM | 44 | 1 | 260 | 16 |
| 5224 | 169_49 | 7.5 μM | 38 | 1 | 245 | 32 |
| 5224 | 169_50 | 7.5 μM | 35 | 2 | 314 | 28 |
| 5224 | 169_51 | 7.5 μM | 41 | 5 | 281 | 5 |
| 5224 | 169_52 | 7.5 μM | 36 | 1 | 282 | 1 |
| 5224 | 169_53 | 7.5 μM | 38 | 7 | 301 | 7 |
| 5224 | 169_54 | 7.5 μM | 36 | 3 | 304 | 6 |
| 5224 | 169_55 | 7.5 μM | 52 | 5 | 246 | 23 |
| 5224 | 169_56 | 7.5 μM | 33 | 15 | 302 | 15 |
| 5224 | 169_57 | 7.5 μM | 34 | 16 | 273 | 16 |
| 5784 | 570_1 | 7.5 μM | 47 | 0 | 274 | 7 |
| 5784 | 570_2 | 7.5 μM | 47 | 8 | 232 | 8 |
| 5784 | 570_3 | 7.5 μM | 55 | 25 | 280 | 54 |
| 5784 | 570_4 | 7.5 μM | 61 | 11 | 235 | 54 |
| 5784 | 570_5 | 7.5 μM | 72 | 10 | 198 | 30 |
| 5784 | 570_6 | 7.5 μM | 66 | 8 | 244 | 50 |
| 5784 | 570_7 | 7.5 μM | 42 | 1 | 284 | 13 |
| 5784 | 570_8 | 7.5 μM | 43 | 6 | 257 | 11 |
| 5784 | 570_9 | 7.5 μM | 32 | 9 | 242 | 30 |
| 5785 | 571_1 | 7.5 μM | 40 | 1 | 269 | 35 |
| 5785 | 571_2 | 7.5 μM | 42 | 3 | 187 | 6 |
| 5785 | 571_3 | 7.5 μM | 46 | 6 | 242 | 8 |
| 5785 | 571_4 | 7.5 μM | 37 | 4 | 282 | 19 |
| 5785 | 571_5 | 7.5 μM | 48 | 16 | 296 | 2 |
| 5785 | 571_6 | 7.5 μM | 37 | 6 | 274 | 10 |
| 5785 | 571_7 | 7.5 μM | 39 | 1 | 260 | 8 |
| 5785 | 571_8 | 7.5 μM | 35 | 1 | 252 | 3 |
| 5785 | 571_9 | 7.5 μM | 30 | 5 | 297 | 10 |
| 5786 | 572_1 | 7.5 μM | 34 | 4 | 279 | 29 |
| 5786 | 572_2 | 7.5 μM | 63 | 10 | 152 | 4 |
| 5786 | 572_3 | 7.5 μM | 39 | 0 | 280 | 42 |
| 5786 | 572_4 | 7.5 μM | 40 | 1 | 283 | 14 |
| 5786 | 572_5 | 7.5 μM | 38 | 6 | 310 | 11 |
| 5786 | 572_6 | 7.5 μM | 33 | 1 | 316 | 18 |
| 5786 | 572_7 | 7.5 μM | 35 | 1 | 318 | 11 |
| 5786 | 572_8 | 7.5 μM | 47 | 9 | 310 | 19 |
| 5786 | 572_9 | 7.5 μM | 31 | 7 | 321 | 12 |
| 8116 | 573_1 | 7.5 μM | 39 | 8 | 316 | 28 |
| 8116 | 573_2 | 7.5 μM | 49 | 15 | 305 | 41 |
| 8116 | 573_3 | 7.5 μM | 46 | 13 | 308 | 3 |
| 8116 | 573_4 | 7.5 μM | 39 | 3 | 332 | 6 |
| 8116 | 573_5 | 7.5 μM | 34 | 6 | 278 | 12 |
| 8116 | 573_6 | 7.5 μM | 42 | 1 | 285 | 10 |
| 8116 | 573_7 | 7.5 μM | 38 | 0 | 289 | 33 |

TABLE 8-continued

Oligonucleotide activity in patient derived human neuronal cell cultures.

| Start SEQ ID NO 1 | CMP ID NO | Conc μM | % of Mock UBE3A-SUP | sd | % of Mock UBE3A | sd |
|---|---|---|---|---|---|---|
| 8116 | 573_8 | 7.5 μM | 40 | 4 | 311 | 20 |
| 8116 | 573_9 | 7.5 μM | 57 | 9 | 315 | 5 |
| 8117 | 574_1 | 7.5 μM | 40 | 2 | 291 | 35 |
| 8117 | 574_2 | 7.5 μM | 42 | 3 | 343 | 18 |
| 8117 | 574_3 | 7.5 μM | 36 | 6 | 325 | 8 |
| 8117 | 574_4 | 7.5 μM | 38 | 1 | 279 | 15 |
| 8117 | 574_5 | 7.5 μM | 42 | 6 | 308 | 10 |
| 8117 | 574_6 | 7.5 μM | 47 | 8 | 340 | 11 |
| 8117 | 574_7 | 7.5 μM | 43 | 0 | 308 | 42 |
| 8117 | 574_8 | 7.5 μM | 44 | 6 | 268 | 10 |
| 8117 | 574_9 | 7.5 μM | 41 | 8 | 241 | 22 |
| 8118 | 575_1 | 7.5 μM | 47 | 0 | 198 | 28 |
| 8118 | 575_2 | 7.5 μM | 83 | 26 | 253 | 31 |
| 8118 | 575_3 | 7.5 μM | 48 | 4 | 348 | 5 |
| 8118 | 575_4 | 7.5 μM | 37 | 2 | 269 | 7 |
| 8118 | 575_5 | 7.5 μM | 43 | 6 | 258 | 17 |
| 8118 | 575_6 | 7.5 μM | 50 | 6 | 286 | 3 |
| 8118 | 575_7 | 7.5 μM | 37 | 2 | 331 | 30 |
| 8118 | 575_8 | 7.5 μM | 47 | 7 | 264 | 1 |
| 8118 | 575_9 | 7.5 μM | 64 | 23 | 243 | 3 |
| 8119 | 576_1 | 7.5 μM | 47 | 1 | 272 | 14 |
| 8119 | 576_2 | 7.5 μM | 109 | 31 | 119 | 3 |
| 8119 | 576_3 | 7.5 μM | 36 | 3 | 287 | 6 |
| 8119 | 576_4 | 7.5 μM | 35 | 3 | 285 | 23 |
| 8119 | 576_5 | 7.5 μM | 49 | 10 | 222 | 1 |
| 8119 | 576_6 | 7.5 μM | 79 | 12 | 132 | 10 |
| 8119 | 576_7 | 7.5 μM | 76 | 4 | 132 | 3 |
| 8119 | 576_8 | 7.5 μM | 62 | 1 | 147 | 5 |
| 8119 | 576_9 | 7.5 μM | 43 | 3 | 230 | 5 |
| 8120 | 577_1 | 7.5 μM | 57 | 3 | 158 | 15 |
| 8120 | 577_2 | 7.5 μM | 39 | 4 | 279 | 60 |
| 8120 | 577_3 | 7.5 μM | 38 | 1 | 290 | 68 |
| 8120 | 577_4 | 7.5 μM | 77 | 11 | 148 | 11 |
| 8120 | 577_5 | 7.5 μM | 31 | 6 | 272 | 36 |
| 8120 | 577_6 | 7.5 μM | 38 | 8 | 228 | 32 |
| 8120 | 577_7 | 7.5 μM | 40 | 8 | 246 | 39 |
| 8120 | 577_8 | 7.5 μM | 43 | 11 | 256 | 26 |
| 8120 | 577_9 | 7.5 μM | 85 | 32 | 109 | 6 |
| 8584 | 578_1 | 7.5 μM | 57 | 7 | 199 | 7 |
| 8584 | 578_2 | 7.5 μM | 40 | 5 | 263 | 3 |
| 8584 | 578_3 | 7.5 μM | 40 | 2 | 289 | 23 |
| 8584 | 578_4 | 7.5 μM | 43 | 8 | 199 | 16 |
| 8584 | 578_5 | 7.5 μM | 42 | 1 | 256 | 15 |
| 8584 | 578_6 | 7.5 μM | 42 | 6 | 241 | 10 |
| 8584 | 578_7 | 7.5 μM | 42 | 5 | 329 | 20 |
| 8584 | 578_8 | 7.5 μM | 49 | 7 | 271 | 13 |
| 8584 | 578_9 | 7.5 μM | 45 | 3 | 222 | 3 |
| 8585 | 579_1 | 7.5 μM | 45 | 0 | 208 | 8 |
| 8585 | 579_2 | 7.5 μM | 51 | 4 | 226 | 6 |
| 8585 | 579_3 | 7.5 μM | 54 | 5 | 178 | 8 |
| 8585 | 579_4 | 7.5 μM | 41 | 4 | 328 | 13 |
| 8585 | 579_5 | 7.5 μM | 50 | 5 | 272 | 3 |
| 8585 | 579_6 | 7.5 μM | 86 | 12 | 161 | 0 |
| 8585 | 579_7 | 7.5 μM | 72 | 5 | 155 | 15 |
| 8585 | 579_8 | 7.5 μM | 57 | 3 | 230 | 14 |
| 8585 | 579_9 | 7.5 μM | 83 | 0 | 123 | 1 |
| 8586 | 580_1 | 7.5 μM | 37 | 2 | 313 | 13 |
| 8586 | 580_2 | 7.5 μM | 43 | 1 | 266 | 3 |
| 8586 | 580_3 | 7.5 μM | 42 | 5 | 303 | 5 |
| 8586 | 580_4 | 7.5 μM | 57 | 4 | 225 | 26 |
| 8586 | 580_5 | 7.5 μM | 51 | 4 | 228 | 35 |
| 8586 | 580_6 | 7.5 μM | 44 | 4 | 253 | 15 |
| 8586 | 580_7 | 7.5 μM | 50 | 1 | 241 | 10 |
| 8586 | 580_8 | 7.5 μM | 44 | 0 | 227 | 26 |
| 8586 | 580_9 | 7.5 μM | 31 | 5 | 323 | 31 |
| 8587 | 581_1 | 7.5 μM | 50 | 6 | 223 | 30 |
| 8587 | 581_2 | 7.5 μM | 66 | 7 | 199 | 19 |
| 8587 | 581_3 | 7.5 μM | 56 | 8 | 197 | 9 |
| 8587 | 581_4 | 7.5 μM | 57 | 12 | 270 | 24 |
| 8587 | 581_5 | 7.5 μM | 51 | 12 | 259 | 12 |
| 8587 | 581_6 | 7.5 μM | 39 | 4 | 282 | 2 |
| 8587 | 581_7 | 7.5 μM | 38 | 11 | 263 | 5 |
| 8587 | 581_8 | 7.5 μM | 45 | 10 | 203 | 19 |
| 8587 | 581_9 | 7.5 μM | 43 | 2 | 234 | 10 |
| 9209 | 582_1 | 7.5 μM | 61 | 7 | 225 | 7 |
| 9209 | 582_2 | 7.5 μM | 46 | 9 | 341 | 36 |
| 9209 | 582_3 | 7.5 μM | 44 | 9 | 306 | 38 |
| 9209 | 582_4 | 7.5 μM | 43 | 1 | 249 | 5 |
| 9209 | 582_5 | 7.5 μM | 33 | 16 | 306 | 6 |
| 9209 | 582_6 | 7.5 μM | 37 | 8 | 329 | 19 |
| 9209 | 582_7 | 7.5 μM | 44 | 9 | 289 | 4 |
| 9209 | 582_8 | 7.5 μM | 39 | 3 | 314 | 20 |
| 9209 | 582_9 | 7.5 μM | 41 | 4 | 299 | 25 |
| 9210 | 583_1 | 7.5 μM | 43 | 5 | 319 | 25 |
| 9210 | 583_2 | 7.5 μM | 53 | 9 | 352 | 5 |
| 9210 | 583_3 | 7.5 μM | 42 | 2 | 362 | 42 |
| 9210 | 583_4 | 7.5 μM | 46 | 5 | 225 | 13 |
| 9210 | 583_5 | 7.5 μM | 39 | 6 | 343 | 21 |
| 9210 | 583_6 | 7.5 μM | 44 | 9 | 298 | 8 |
| 9210 | 583_7 | 7.5 μM | 37 | 5 | 332 | 9 |
| 9210 | 583_8 | 7.5 μM | 42 | 6 | 343 | 25 |
| 9210 | 583_9 | 7.5 μM | 36 | 2 | 341 | 9 |
| 9211 | 584_1 | 7.5 μM | 45 | 5 | 343 | 39 |
| 9211 | 584_2 | 7.5 μM | 42 | 2 | 298 | 22 |
| 9211 | 584_3 | 7.5 μM | 44 | 10 | 321 | 2 |
| 9211 | 584_4 | 7.5 μM | 50 | 1 | 299 | 5 |
| 9211 | 584_5 | 7.5 μM | 44 | 1 | 319 | 25 |
| 9211 | 584_6 | 7.5 μM | 50 | 6 | 323 | 13 |
| 9211 | 584_7 | 7.5 μM | 42 | 4 | 316 | 27 |
| 9211 | 584_8 | 7.5 μM | 53 | 3 | 217 | 11 |
| 9212 | 208_2 | 7.5 μM | 44 | 7 | 312 | 26 |
| 9212 | 208_3 | 7.5 μM | 38 | 2 | 331 | 21 |
| 9212 | 208_4 | 7.5 μM | 47 | 3 | 353 | 11 |
| 9212 | 208_5 | 7.5 μM | 54 | 11 | 348 | 14 |
| 9212 | 208_6 | 7.5 μM | 51 | 12 | 310 | 8 |
| 9212 | 208_7 | 7.5 μM | 60 | 9 | 224 | 11 |
| 9213 | 209_2 | 7.5 μM | 44 | 12 | 242 | 21 |
| 9213 | 209_3 | 7.5 μM | 37 | 12 | 335 | 12 |
| 9213 | 209_4 | 7.5 μM | 55 | 7 | 350 | 2 |
| 9213 | 209_5 | 7.5 μM | 47 | 7 | 337 | 19 |
| 9213 | 209_6 | 7.5 μM | 51 | 8 | 300 | 19 |
| 9213 | 209_7 | 7.5 μM | 47 | 15 | 342 | 23 |
| 9213 | 209_8 | 7.5 μM | 45 | 12 | 289 | 5 |
| 9213 | 209_9 | 7.5 μM | 41 | 1 | 368 | 37 |
| 9213 | 209_10 | 7.5 μM | 40 | 4 | 315 | 1 |
| 11511 | 585_1 | 7.5 μM | 41 | 7 | 350 | 12 |
| 11511 | 585_2 | 7.5 μM | 44 | 4 | 233 | 7 |
| 11511 | 585_3 | 7.5 μM | 40 | 8 | 310 | 31 |
| 11511 | 585_4 | 7.5 μM | 33 | 8 | 324 | 41 |
| 11511 | 585_5 | 7.5 μM | 29 | 3 | 314 | 23 |
| 11511 | 585_6 | 7.5 μM | 38 | 4 | 332 | 15 |
| 11511 | 585_7 | 7.5 μM | 30 | 2 | 315 | 15 |
| 11511 | 585_8 | 7.5 μM | 36 | 11 | 328 | 37 |
| 11511 | 585_9 | 7.5 μM | 39 | 5 | 303 | 49 |
| 11512 | 586_1 | 7.5 μM | 60 | 3 | 236 | 5 |
| 11512 | 586_2 | 7.5 μM | 40 | 9 | 282 | 53 |
| 11512 | 586_3 | 7.5 μM | 36 | 1 | 279 | 11 |
| 11512 | 586_4 | 7.5 μM | 34 | 3 | 288 | 21 |
| 11512 | 586_5 | 7.5 μM | 30 | 1 | 270 | 4 |
| 11512 | 586_6 | 7.5 μM | 29 | 5 | 269 | 24 |
| 11512 | 586_7 | 7.5 μM | 33 | 4 | 263 | 6 |
| 11512 | 586_8 | 7.5 μM | 32 | 4 | 270 | 4 |
| 11512 | 586_9 | 7.5 μM | 33 | 5 | 310 | 48 |
| 11513 | 587_1 | 7.5 μM | 45 | 2 | 237 | 34 |
| 11513 | 587_2 | 7.5 μM | 44 | 3 | 307 | 4 |
| 11513 | 587_3 | 7.5 μM | 37 | 1 | 285 | 24 |
| 11513 | 587_4 | 7.5 μM | 44 | 1 | 252 | 41 |
| 11513 | 587_5 | 7.5 μM | 51 | 7 | 220 | 29 |
| 11513 | 587_6 | 7.5 μM | 41 | 2 | 262 | 35 |
| 11513 | 587_7 | 7.5 μM | 39 | 7 | 280 | 21 |
| 11513 | 587_8 | 7.5 μM | 48 | 9 | 230 | 11 |
| 11513 | 587_9 | 7.5 μM | 41 | 5 | 270 | 9 |
| 11514 | 588_1 | 7.5 μM | 54 | 9 | 204 | 25 |
| 11514 | 588_2 | 7.5 μM | 98 | 5 | 143 | 4 |
| 11514 | 588_3 | 7.5 μM | 55 | 9 | 180 | 1 |
| 11514 | 588_4 | 7.5 μM | 113 | 24 | 109 | 17 |
| 11514 | 588_5 | 7.5 μM | 66 | 26 | 150 | 5 |
| 11514 | 588_6 | 7.5 μM | 74 | 1 | 131 | 1 |

TABLE 8-continued

Oligonucleotide activity in patient derived human neuronal cell cultures.

| Start SEQ ID NO 1 | CMP ID NO | Conc μM | % of Mock UBE3A-SUP | sd | % of Mock UBE3A | sd |
|---|---|---|---|---|---|---|
| 11514 | 588_7 | 7.5 μM | 79 | 4 | 140 | 9 |
| 11514 | 588_8 | 7.5 μM | 49 | 2 | 235 | 2 |
| 11514 | 588_9 | 7.5 μM | 51 | 10 | 281 | 2 |
| 11515 | 589_1 | 7.5 μM | 61 | 2 | 154 | 9 |
| 11515 | 589_2 | 7.5 μM | 70 | 9 | 126 | 12 |
| 11515 | 589_3 | 7.5 μM | 53 | 3 | 212 | 32 |
| 11515 | 589_4 | 7.5 μM | 93 | 14 | 108 | 14 |
| 11515 | 589_5 | 7.5 μM | 69 | 11 | 191 | 7 |
| 11515 | 589_6 | 7.5 μM | 53 | 9 | 183 | 20 |
| 11515 | 589_7 | 7.5 μM | 45 | 8 | 257 | 4 |
| 11515 | 589_8 | 7.5 μM | 35 | 5 | 213 | 5 |
| 11515 | 589_9 | 7.5 μM | 41 | 2 | 290 | 22 |
| 13223 | 236_2 | 7.5 μM | 39 | 6 | 286 | 21 |
| 13223 | 236_3 | 7.5 μM | 32 | 10 | 256 | 29 |
| 13223 | 236_4 | 7.5 μM | 37 | 5 | 285 | 12 |
| 13223 | 236_5 | 7.5 μM | 33 | 8 | 280 | 19 |
| 13223 | 236_6 | 7.5 μM | 40 | 16 | 295 | 7 |
| 13223 | 236_7 | 7.5 μM | 45 | 10 | 254 | 50 |
| 13223 | 236_8 | 7.5 μM | 41 | 22 | 306 | 50 |
| 13223 | 236_9 | 7.5 μM | 32 | 11 | 292 | 47 |
| 13223 | 236_10 | 7.5 μM | 31 | 10 | 307 | 3 |
| 13223 | 236_11 | 7.5 μM | 52 | 32 | 198 | 29 |
| 13223 | 236_12 | 7.5 μM | 31 | 7 | 261 | 18 |
| 13223 | 236_13 | 7.5 μM | 34 | 3 | 279 | 32 |
| 13223 | 236_14 | 7.5 μM | 38 | 0 | 285 | 75 |
| 13223 | 236_15 | 7.5 μM | 40 | 17 | 307 | 53 |
| 13223 | 236_16 | 7.5 μM | 41 | 6 | 321 | 30 |
| 13224 | 237_2 | 7.5 μM | 49 | 18 | 251 | 38 |
| 13224 | 237_3 | 7.5 μM | 53 | 14 | 236 | 33 |
| 13224 | 237_4 | 7.5 μM | 39 | 0 | 283 | 26 |
| 13224 | 237_5 | 7.5 μM | 43 | 2 | 243 | 2 |
| 13224 | 237_6 | 7.5 μM | 39 | 10 | 265 | 48 |
| 13224 | 237_7 | 7.5 μM | 50 | 3 | 302 | 19 |
| 13224 | 237_8 | 7.5 μM | 46 | 7 | 327 | 43 |
| 13224 | 237_9 | 7.5 μM | 38 | 9 | 287 | 12 |
| 13224 | 237_10 | 7.5 μM | 35 | 6 | 248 | 35 |
| 13224 | 237_11 | 7.5 μM | 41 | 1 | 259 | 24 |
| 13224 | 237_12 | 7.5 μM | 33 | 6 | 303 | 35 |
| 13224 | 237_13 | 7.5 μM | 26 | 4 | 265 | 53 |
| 13224 | 237_14 | 7.5 μM | 30 | 8 | 321 | 15 |
| 13224 | 237_15 | 7.5 μM | 33 | 11 | 315 | 24 |
| 13224 | 237_16 | 7.5 μM | 36 | 11 | 292 | 19 |
| 13225 | 239_2 | 7.5 μM | 35 | 16 | 291 | 30 |
| 13225 | 239_3 | 7.5 μM | 40 | 15 | 311 | 42 |
| 13225 | 239_4 | 7.5 μM | 81 | 6 | 144 | 16 |
| 13225 | 239_5 | 7.5 μM | 90 | 16 | 127 | 11 |
| 13225 | 239_6 | 7.5 μM | 49 | 29 | 282 | 3 |
| 13225 | 239_7 | 7.5 μM | 35 | 4 | 296 | 23 |
| 13225 | 239_8 | 7.5 μM | 40 | 1 | 292 | 48 |
| 13225 | 239_9 | 7.5 μM | 36 | 1 | 318 | 44 |
| 13225 | 239_10 | 7.5 μM | 49 | NA | 304 | NA |
| 13225 | 239_11 | 7.5 μM | 45 | NA | 258 | NA |
| 13225 | 239_12 | 7.5 μM | 43 | 1 | 285 | 1 |
| 13225 | 239_13 | 7.5 μM | 31 | 1 | 308 | 31 |
| 13225 | 239_14 | 7.5 μM | 41 | 8 | 253 | 6 |
| 13225 | 239_15 | 7.5 μM | 28 | 3 | 291 | 16 |
| 13225 | 239_16 | 7.5 μM | 29 | 3 | 314 | 14 |
| 13226 | 590_1 | 7.5 μM | 34 | 1 | 283 | 18 |
| 13226 | 590_2 | 7.5 μM | 49 | 7 | 213 | 17 |
| 13226 | 590_3 | 7.5 μM | 40 | 1 | 274 | 51 |
| 13226 | 590_4 | 7.5 μM | 36 | 1 | 300 | 2 |
| 13226 | 590_5 | 7.5 μM | 37 | 3 | 280 | 36 |
| 13226 | 590_6 | 7.5 μM | 38 | 2 | 204 | 17 |
| 13226 | 590_7 | 7.5 μM | 38 | 5 | 245 | 16 |
| 13226 | 590_8 | 7.5 μM | 30 | 6 | 219 | 34 |
| 13226 | 590_9 | 7.5 μM | 33 | 1 | 269 | 2 |
| 13226 | 590_10 | 7.5 μM | 33 | 2 | 258 | 49 |
| 13226 | 590_11 | 7.5 μM | 48 | 17 | 297 | 31 |
| 13226 | 590_12 | 7.5 μM | 33 | 4 | 317 | 65 |
| 13226 | 590_13 | 7.5 μM | 35 | 7 | 337 | 43 |
| 13226 | 590_14 | 7.5 μM | 25 | 1 | 306 | 22 |
| 13226 | 590_15 | 7.5 μM | 30 | 5 | 299 | 2 |
| 15113 | 591_1 | 7.5 μM | 43 | 3 | 313 | 14 |
| 15113 | 591_2 | 7.5 μM | 52 | 2 | 295 | 24 |
| 15114 | 592_1 | 7.5 μM | 53 | 2 | 232 | 17 |
| 15114 | 592_2 | 7.5 μM | 39 | 1 | 309 | 23 |
| 15114 | 592_3 | 7.5 μM | 46 | 1 | 278 | 12 |
| 15114 | 592_4 | 7.5 μM | 36 | 1 | 328 | 13 |
| 15114 | 592_5 | 7.5 μM | 49 | 9 | 295 | 40 |
| 15114 | 592_6 | 7.5 μM | 46 | 3 | 297 | 10 |
| 15114 | 592_7 | 7.5 μM | 75 | 21 | 160 | 23 |
| 15114 | 592_8 | 7.5 μM | 41 | 10 | 325 | 23 |
| 15114 | 592_9 | 7.5 μM | 55 | 15 | 265 | 3 |
| 15115 | 241_2 | 7.5 μM | 66 | 18 | 168 | 2 |
| 15115 | 241_3 | 7.5 μM | 51 | 15 | 265 | 11 |
| 15115 | 241_4 | 7.5 μM | 49 | 4 | 239 | 7 |
| 15115 | 241_5 | 7.5 μM | 52 | 11 | 314 | 20 |
| 15115 | 241_6 | 7.5 μM | 41 | 13 | 307 | 7 |
| 15115 | 241_7 | 7.5 μM | 38 | 6 | 344 | 33 |
| 15115 | 241_8 | 7.5 μM | 39 | 10 | 329 | 9 |
| 15115 | 241_9 | 7.5 μM | 50 | 11 | 321 | 32 |
| 15115 | 241_10 | 7.5 μM | 48 | 9 | 316 | 1 |
| 15563 | 593_1 | 7.5 μM | 38 | 10 | 282 | 14 |
| 15563 | 593_2 | 7.5 μM | 31 | 5 | 279 | 16 |
| 15563 | 593_3 | 7.5 μM | 34 | 7 | 281 | 16 |
| 15563 | 593_4 | 7.5 μM | 32 | 16 | 318 | 2 |
| 15563 | 594_1 | 7.5 μM | 40 | 2 | 320 | 21 |
| 15563 | 594_2 | 7.5 μM | 54 | 7 | 237 | 14 |
| 15563 | 594_3 | 7.5 μM | 35 | 6 | 300 | 45 |
| 15563 | 594_4 | 7.5 μM | 37 | 7 | 254 | 6 |
| 15564 | 596_1 | 7.5 μM | 47 | 7 | 225 | 35 |
| 15564 | 596_2 | 7.5 μM | 49 | 2 | 184 | 14 |
| 15564 | 596_3 | 7.5 μM | 34 | 8 | 271 | 18 |
| 15564 | 596_4 | 7.5 μM | 45 | 8 | 277 | 29 |
| 15564 | 595_1 | 7.5 μM | 42 | 4 | 254 | 6 |
| 15564 | 595_2 | 7.5 μM | 36 | 9 | 277 | 35 |
| 15564 | 595_3 | 7.5 μM | 40 | 8 | 295 | 31 |
| 15564 | 595_4 | 7.5 μM | 45 | 5 | 173 | 20 |
| 15566 | 597_1 | 7.5 μM | 48 | 6 | 296 | 22 |
| 15566 | 597_2 | 7.5 μM | 44 | 12 | 293 | 8 |
| 15566 | 597_3 | 7.5 μM | 41 | 6 | 318 | 23 |
| 15566 | 597_4 | 7.5 μM | 60 | 9 | 340 | 72 |
| 15567 | 38_3 | 7.5 μM | 41 | 3 | 306 | 14 |
| 15567 | 38_4 | 7.5 μM | 45 | 1 | 303 | 48 |
| 15567 | 38_5 | 7.5 μM | 39 | 15 | 292 | 28 |
| 15567 | 38_6 | 7.5 μM | 46 | 12 | 261 | 40 |
| 15567 | 598_1 | 7.5 μM | 42 | 2 | 257 | 31 |
| 15567 | 598_2 | 7.5 μM | 41 | 12 | 272 | 46 |
| 15567 | 598_3 | 7.5 μM | 54 | 9 | 281 | 29 |
| 15567 | 598_4 | 7.5 μM | 45 | 8 | 307 | 6 |
| 15568 | 599_1 | 7.5 μM | 47 | 3 | 326 | 68 |
| 15568 | 599_2 | 7.5 μM | 60 | 14 | 307 | 30 |
| 15568 | 599_3 | 7.5 μM | 50 | 8 | 274 | 24 |
| 15568 | 599_4 | 7.5 μM | 45 | 6 | 250 | 12 |
| 15568 | 600_1 | 7.5 μM | 37 | 6 | 251 | 1 |
| 15568 | 600_2 | 7.5 μM | 45 | 11 | 267 | 15 |
| 15568 | 600_3 | 7.5 μM | 44 | 5 | 278 | 1 |
| 15568 | 600_4 | 7.5 μM | 41 | 10 | 265 | 5 |
| 15569 | 601_1 | 7.5 μM | 42 | 12 | 271 | 18 |
| 15569 | 601_2 | 7.5 μM | 38 | 6 | 269 | 24 |
| 15569 | 601_3 | 7.5 μM | 39 | 4 | 260 | 34 |
| 15569 | 601_4 | 7.5 μM | 56 | 8 | 146 | 1 |
| 15570 | 244_2 | 7.5 μM | 46 | 1 | 338 | 6 |
| 15570 | 244_3 | 7.5 μM | 47 | 0 | 275 | 47 |
| 15570 | 244_4 | 7.5 μM | 47 | 8 | 281 | 67 |
| 15570 | 244_5 | 7.5 μM | 41 | 8 | 258 | 52 |
| 15570 | 39_2 | 7.5 μM | 53 | 4 | 339 | 25 |
| 15570 | 39_3 | 7.5 μM | 65 | 5 | 200 | 17 |
| 15570 | 39_4 | 7.5 μM | 47 | 7 | 321 | 6 |
| 15570 | 39_5 | 7.5 μM | 46 | 3 | 289 | 20 |
| 15571 | 602_1 | 7.5 μM | 34 | 5 | 278 | 29 |
| 15571 | 602_2 | 7.5 μM | 39 | 8 | 254 | 37 |
| 15571 | 602_3 | 7.5 μM | 41 | 10 | 266 | 23 |
| 15571 | 602_4 | 7.5 μM | 42 | 8 | 256 | 40 |
| 15571 | 40_2 | 7.5 μM | 58 | 0 | 325 | 4 |
| 15571 | 40_3 | 7.5 μM | 58 | 2 | 326 | 35 |
| 15571 | 40_4 | 7.5 μM | 54 | 1 | 306 | 3 |
| 15571 | 40_5 | 7.5 μM | 44 | 2 | 322 | 4 |

TABLE 8-continued

Oligonucleotide activity in patient derived human neuronal cell cultures.

| Start SEQ ID NO 1 | CMP ID NO | Conc μM | % of Mock UBE3A-SUP | sd | % of Mock UBE3A | sd |
|---|---|---|---|---|---|---|
| 15571 | 40_6 | 7.5 μM | 43 | 4 | 293 | 17 |
| 15571 | 40_7 | 7.5 μM | 53 | 7 | 343 | 20 |
| 15571 | 40_8 | 7.5 μM | 52 | 1 | 337 | 17 |
| 15572 | 604_1 | 7.5 μM | 58 | 1 | 289 | 3 |
| 15572 | 604_2 | 7.5 μM | 63 | 12 | 230 | 5 |
| 15572 | 604_3 | 7.5 μM | 57 | 3 | 306 | 23 |
| 15572 | 604_4 | 7.5 μM | 46 | 6 | 324 | 4 |
| 15572 | 603_1 | 7.5 μM | 60 | 7 | 339 | 31 |
| 15572 | 603_2 | 7.5 μM | 70 | 0 | 279 | 19 |
| 15572 | 603_3 | 7.5 μM | 59 | 9 | 290 | 48 |
| 15572 | 603_4 | 7.5 μM | 85 | 11 | 123 | 24 |
| 15573 | 605_1 | 7.5 μM | 56 | 5 | 288 | 3 |
| 15573 | 605_2 | 7.5 μM | 58 | 4 | 286 | 6 |
| 15573 | 605_3 | 7.5 μM | 59 | 3 | 261 | 9 |
| 15573 | 605_4 | 7.5 μM | 69 | 24 | 328 | 17 |
| 15573 | 606_1 | 7.5 μM | 50 | 4 | 282 | 19 |
| 15573 | 606_2 | 7.5 μM | 112 | NA | 133 | NA |
| 15573 | 606_3 | 7.5 μM | 55 | 22 | 254 | 43 |
| 15573 | 606_4 | 7.5 μM | 107 | 59 | 116 | 2 |
| 15574 | 607_1 | 7.5 μM | 56 | 2 | 337 | 31 |
| 15574 | 607_2 | 7.5 μM | 59 | 1 | 254 | 10 |
| 15574 | 607_3 | 7.5 μM | 53 | 0 | 295 | 26 |
| 15574 | 607_4 | 7.5 μM | 48 | 3 | 268 | 15 |
| 25248 | 608_1 | 7.5 μM | 86 | 7 | 189 | 5 |
| 25248 | 608_2 | 7.5 μM | 102 | 13 | 136 | 3 |
| 25248 | 608_3 | 7.5 μM | 54 | 17 | 280 | 12 |
| 25248 | 608_4 | 7.5 μM | 71 | 8 | 219 | 31 |
| 25248 | 608_5 | 7.5 μM | 59 | 20 | 179 | 16 |
| 25248 | 608_6 | 7.5 μM | 71 | 2 | 198 | 0 |
| 25248 | 608_7 | 7.5 μM | 47 | 3 | 230 | 21 |
| 25248 | 608_8 | 7.5 μM | 55 | 12 | 287 | 13 |
| 25248 | 608_9 | 7.5 μM | 66 | 19 | 297 | 18 |
| 25249 | 609_1 | 7.5 μM | 58 | 19 | 264 | 7 |
| 25249 | 609_2 | 7.5 μM | 88 | 6 | 156 | 5 |
| 25249 | 609_3 | 7.5 μM | 76 | 19 | 140 | 13 |
| 25249 | 609_4 | 7.5 μM | 50 | 15 | 185 | 6 |
| 25249 | 609_5 | 7.5 μM | 95 | 29 | 139 | 1 |
| 25249 | 609_6 | 7.5 μM | 86 | 15 | 126 | 7 |
| 25249 | 609_7 | 7.5 μM | 72 | 9 | 174 | 1 |
| 25249 | 609_8 | 7.5 μM | 64 | 3 | 189 | 18 |
| 25249 | 609_9 | 7.5 μM | 77 | 12 | 223 | 35 |
| 25250 | 610_1 | 7.5 μM | 55 | 17 | 233 | 7 |
| 25250 | 610_2 | 7.5 μM | 52 | 15 | 233 | 9 |
| 25250 | 610_3 | 7.5 μM | 77 | 5 | 151 | 11 |
| 25250 | 610_4 | 7.5 μM | 48 | 0 | 242 | 21 |
| 25250 | 610_5 | 7.5 μM | 59 | 8 | 234 | 0 |
| 25250 | 610_6 | 7.5 μM | 59 | 12 | 208 | 23 |
| 25250 | 610_7 | 7.5 μM | 69 | 7 | 216 | 5 |
| 25250 | 610_8 | 7.5 μM | 70 | 16 | 211 | 2 |
| 25250 | 610_9 | 7.5 μM | 77 | 22 | 157 | 19 |
| 25251 | 611_1 | 7.5 μM | 43 | 4 | 306 | 10 |
| 25251 | 611_2 | 7.5 μM | 43 | 1 | 300 | 36 |
| 25251 | 611_3 | 7.5 μM | 43 | 17 | 306 | 6 |
| 25251 | 611_4 | 7.5 μM | 40 | 1 | 320 | 37 |
| 25251 | 611_5 | 7.5 μM | 48 | 9 | 273 | 7 |
| 25251 | 611_6 | 7.5 μM | 51 | 2 | 302 | 26 |
| 25251 | 611_7 | 7.5 μM | 40 | 8 | 326 | 8 |
| 25251 | 611_8 | 7.5 μM | 55 | 10 | 330 | 17 |
| 25251 | 611_9 | 7.5 μM | 40 | 3 | 297 | 11 |
| 25252 | 612_1 | 7.5 μM | 58 | 9 | 219 | 5 |
| 25252 | 612_2 | 7.5 μM | 54 | 9 | 282 | 4 |
| 25252 | 612_3 | 7.5 μM | 56 | 13 | 265 | 35 |
| 25252 | 612_4 | 7.5 μM | 81 | 16 | 239 | 51 |
| 25252 | 612_5 | 7.5 μM | 57 | 2 | 234 | 25 |
| 25252 | 612_6 | 7.5 μM | 76 | 18 | 221 | 8 |
| 25252 | 612_7 | 7.5 μM | 45 | 7 | 285 | 11 |
| 25252 | 612_8 | 7.5 μM | 50 | 8 | 231 | 4 |
| 25252 | 612_9 | 7.5 μM | 51 | 3 | 305 | 17 |
| 29636 | 271_1 | 7.5 μM | 35 | 4 | 345 | 29 |
| 29636 | 271_1 | 7.5 μM | 32 | 6 | 383 | 31 |
| 29636 | 271_1 | 7.5 μM | 42 | 7 | 292 | 13 |
| 29636 | 271_1 | 7.5 μM | 40 | 1 | 309 | 41 |
| 29636 | 271_1 | 7.5 μM | 41 | 10 | 339 | 17 |
| 29636 | 271_1 | 7.5 μM | 35 | 8 | 306 | 40 |
| 29636 | 271_1 | 7.5 μM | 33 | 1 | 320 | 12 |
| 29636 | 271_1 | 7.5 μM | 43 | 1 | 347 | 7 |
| 29636 | 271_1 | 7.5 μM | 36 | 2 | 339 | 19 |
| 29636 | 271_1 | 7.5 μM | 36 | 1 | 315 | 5 |
| 29636 | 271_1 | 7.5 μM | 41 | 1 | 326 | 16 |
| 29636 | 271_1 | 7.5 μM | 38 | 2 | 344 | 1 |
| 29636 | 271_1 | 7.5 μM | 34 | 6 | 341 | 8 |
| 29636 | 271_1 | 7.5 μM | 42 | 9 | 320 | 1 |
| 29636 | 271_1 | 7.5 μM | 31 | 8 | 344 | 37 |
| 29636 | 271_1 | 7.5 μM | 44 | 2 | 335 | 11 |
| 29636 | 271_1 | 7.5 μM | 32 | 0 | 316 | 17 |
| 29636 | 271_1 | 7.5 μM | 43 | 11 | 323 | 2 |
| 29636 | 271_1 | 7.5 μM | 35 | 7 | 340 | 2 |
| 29636 | 271_1 | 7.5 μM | 43 | 1 | 340 | 8 |
| 29636 | 271_1 | 7.5 μM | 33 | 4 | 296 | 27 |
| 29636 | 271_1 | 7.5 μM | 38 | 5 | 334 | 4 |
| 29636 | 271_1 | 7.5 μM | 36 | 4 | 341 | 22 |
| 29636 | 271_1 | 7.5 μM | 48 | 4 | 334 | 3 |
| 29636 | 271_1 | 7.5 μM | 36 | 8 | 303 | 13 |
| 29636 | 271_1 | 7.5 μM | 36 | 0 | 343 | 7 |
| 29636 | 271_1 | 7.5 μM | 39 | 1 | 326 | 1 |
| 29636 | 271_1 | 7.5 μM | 38 | 2 | 346 | 14 |
| 29636 | 271_1 | 7.5 μM | 32 | 0 | 332 | 11 |
| 29636 | 271_1 | 7.5 μM | 39 | 4 | 330 | 23 |
| 29636 | 271_1 | 7.5 μM | 39 | 7 | 346 | 33 |
| 29636 | 271_1 | 7.5 μM | 40 | 1 | 329 | 14 |
| 29636 | 271_1 | 7.5 μM | 34 | 6 | 316 | 38 |
| 29636 | 271_1 | 7.5 μM | 33 | 4 | 317 | 14 |
| 29636 | 271_1 | 7.5 μM | 41 | 6 | 328 | 11 |
| 29636 | 271_1 | 7.5 μM | 45 | 2 | 345 | 3 |
| 29636 | 271_1 | 7.5 μM | 37 | 1 | 330 | 3 |
| 29636 | 271_1 | 7.5 μM | 45 | 7 | 322 | 18 |
| 29636 | 271_1 | 7.5 μM | 36 | 3 | 334 | 13 |
| 29636 | 271_1 | 7.5 μM | 33 | 8 | 333 | 3 |
| 29636 | 271_1 | 7.5 μM | 35 | 10 | 321 | 43 |
| 29636 | 271_1 | 7.5 μM | 41 | 3 | 323 | 18 |
| 29636 | 271_1 | 7.5 μM | 39 | 8 | 354 | 39 |
| 29636 | 271_1 | 7.5 μM | 35 | 2 | 327 | 23 |
| 30599 | 613_1 | 7.5 μM | 73 | 29 | 172 | 22 |
| 30599 | 613_2 | 7.5 μM | 87 | 40 | 114 | 9 |
| 30599 | 613_3 | 7.5 μM | 59 | 23 | 168 | 23 |
| 30599 | 613_4 | 7.5 μM | 43 | 15 | 281 | 31 |
| 30599 | 613_5 | 7.5 μM | 51 | 3 | 271 | 28 |
| 30600 | 614_1 | 7.5 μM | 56 | 11 | 179 | 22 |
| 30600 | 614_2 | 7.5 μM | 96 | 40 | 100 | 7 |
| 30600 | 614_3 | 7.5 μM | 41 | 7 | 246 | 27 |
| 30600 | 614_4 | 7.5 μM | 47 | 19 | 283 | 14 |
| 30600 | 614_5 | 7.5 μM | 52 | 21 | 209 | 16 |
| 30600 | 615_1 | 7.5 μM | 61 | 19 | 197 | 12 |
| 30600 | 615_2 | 7.5 μM | 45 | 11 | 287 | 25 |
| 30600 | 615_3 | 7.5 μM | 102 | NA | 115 | NA |
| 30600 | 615_4 | 7.5 μM | 72 | NA | 170 | NA |
| 30600 | 615_5 | 7.5 μM | 95 | NA | 138 | NA |
| 30601 | 285_2 | 7.5 μM | 83 | NA | 165 | NA |
| 30601 | 285_3 | 7.5 μM | 124 | NA | 111 | NA |
| 30601 | 285_4 | 7.5 μM | 69 | NA | 183 | NA |
| 30601 | 285_5 | 7.5 μM | 47 | 23 | 211 | 7 |
| 30601 | 285_6 | 7.5 μM | 46 | 12 | 183 | 6 |
| 30601 | 617_1 | 7.5 μM | 67 | 26 | 190 | 19 |
| 30601 | 617_2 | 7.5 μM | 74 | 35 | 137 | 6 |
| 30601 | 617_3 | 7.5 μM | 51 | 16 | 211 | 4 |
| 30601 | 617_4 | 7.5 μM | 65 | 22 | 142 | 11 |
| 30601 | 617_5 | 7.5 μM | 43 | 8 | 298 | 26 |
| 30601 | 616_1 | 7.5 μM | 50 | 22 | 181 | 12 |
| 30601 | 616_2 | 7.5 μM | 37 | 13 | 276 | 33 |
| 30601 | 616_3 | 7.5 μM | 38 | 16 | 264 | 9 |
| 30601 | 616_4 | 7.5 μM | 43 | NA | 304 | NA |
| 30601 | 616_5 | 7.5 μM | 50 | NA | 229 | NA |
| 30602 | 619_1 | 7.5 μM | 90 | 43 | 131 | 22 |
| 30602 | 619_2 | 7.5 μM | 78 | 40 | 138 | 2 |
| 30602 | 619_3 | 7.5 μM | 66 | 22 | 123 | 8 |
| 30602 | 619_4 | 7.5 μM | 100 | 43 | 96 | 5 |
| 30602 | 619_5 | 7.5 μM | 75 | 17 | 157 | 5 |
| 30602 | 618_1 | 7.5 μM | 46 | 16 | 226 | 12 |

TABLE 8-continued

Oligonucleotide activity in patient derived human neuronal cell cultures.

| Start SEQ ID NO 1 | CMP ID NO | Conc µM | % of Mock UBE3A-SUP | sd | % of Mock UBE3A | sd |
|---|---|---|---|---|---|---|
| 30602 | 618_2 | 7.5 µM | 68 | NA | 151 | NA |
| 30602 | 618_3 | 7.5 µM | 52 | 4 | 207 | 18 |
| 30602 | 618_4 | 7.5 µM | 57 | 12 | 223 | 2 |
| 30602 | 618_5 | 7.5 µM | 54 | 2 | 211 | 3 |
| 30603 | 620_1 | 7.5 µM | 106 | 23 | 110 | 16 |
| 30603 | 620_2 | 7.5 µM | 48 | 10 | 243 | 18 |
| 30603 | 620_3 | 7.5 µM | 53 | 1 | 174 | 32 |
| 30603 | 620_4 | 7.5 µM | 81 | 0 | 138 | 15 |
| 30603 | 620_5 | 7.5 µM | 56 | 5 | 218 | 9 |
| 30604 | 621_1 | 7.5 µM | 39 | 4 | 304 | 10 |
| 30604 | 621_2 | 7.5 µM | 35 | 7 | 311 | 3 |
| 30604 | 621_3 | 7.5 µM | 67 | 18 | 142 | 8 |
| 30604 | 621_4 | 7.5 µM | 34 | 6 | 273 | 21 |
| 30604 | 621_5 | 7.5 µM | 36 | 5 | 266 | 18 |
| 30605 | 622_1 | 7.5 µM | 42 | 1 | 242 | 28 |
| 30605 | 622_2 | 7.5 µM | 31 | 10 | 300 | 8 |
| 30605 | 622_3 | 7.5 µM | 35 | 3 | 319 | 11 |
| 30605 | 622_4 | 7.5 µM | 37 | 4 | 281 | 5 |
| 30605 | 622_5 | 7.5 µM | 39 | 5 | 306 | 11 |
| 30606 | 623_1 | 7.5 µM | 47 | 3 | 287 | 1 |
| 30606 | 623_2 | 7.5 µM | 74 | 23 | 166 | 7 |
| 30606 | 623_3 | 7.5 µM | 82 | 1 | 149 | 8 |
| 30606 | 623_4 | 7.5 µM | 66 | 9 | 135 | 8 |
| 30606 | 623_5 | 7.5 µM | 78 | 7 | 128 | 12 |
| 30608 | 624_1 | 7.5 µM | 84 | 13 | 185 | 25 |
| 30608 | 624_2 | 7.5 µM | 35 | 2 | 245 | 9 |
| 30608 | 624_3 | 7.5 µM | 31 | 3 | 267 | 9 |
| 30608 | 624_4 | 7.5 µM | 39 | 16 | 257 | 13 |
| 30608 | 624_5 | 7.5 µM | 34 | 3 | 283 | 4 |
| 30666 | 625_1 | 7.5 µM | 45 | 5 | 286 | 39 |
| 30666 | 625_2 | 7.5 µM | 39 | 3 | 280 | 13 |
| 30666 | 625_3 | 7.5 µM | 40 | 10 | 258 | 9 |
| 30666 | 625_4 | 7.5 µM | 41 | 14 | 234 | 39 |
| 30666 | 625_5 | 7.5 µM | 42 | 5 | 293 | 26 |
| 30666 | 625_6 | 7.5 µM | 44 | 0 | 284 | 25 |
| 30666 | 625_7 | 7.5 µM | 46 | 3 | 271 | 4 |
| 30666 | 625_8 | 7.5 µM | 47 | 5 | 256 | 17 |
| 30666 | 625_9 | 7.5 µM | 40 | 7 | 302 | 2 |
| 30667 | 626_1 | 7.5 µM | 38 | 1 | 279 | 10 |
| 30667 | 626_2 | 7.5 µM | 39 | 21 | 329 | 22 |
| 30667 | 626_3 | 7.5 µM | 59 | 12 | 265 | 65 |
| 30667 | 626_4 | 7.5 µM | 39 | 5 | 318 | 25 |
| 30667 | 626_5 | 7.5 µM | 36 | 2 | 302 | 33 |
| 30667 | 626_6 | 7.5 µM | 36 | 6 | 273 | 34 |
| 30667 | 626_7 | 7.5 µM | 30 | 0 | 299 | 29 |
| 30667 | 626_8 | 7.5 µM | 35 | 4 | 277 | 43 |
| 30667 | 626_9 | 7.5 µM | 32 | 3 | 275 | 22 |
| 30668 | 627_1 | 7.5 µM | 71 | 3 | 131 | 11 |
| 30668 | 627_2 | 7.5 µM | 49 | 4 | 226 | 30 |
| 30668 | 627_3 | 7.5 µM | 64 | 5 | 147 | 8 |
| 30668 | 627_4 | 7.5 µM | 52 | 6 | 176 | 9 |
| 30668 | 627_5 | 7.5 µM | 78 | 14 | 108 | 3 |
| 30668 | 627_6 | 7.5 µM | 40 | 1 | 183 | 23 |
| 30668 | 627_7 | 7.5 µM | 85 | 8 | 116 | 2 |
| 30668 | 627_8 | 7.5 µM | 45 | 1 | 128 | 7 |
| 30668 | 627_9 | 7.5 µM | 42 | 5 | 215 | 36 |
| 30669 | 628_1 | 7.5 µM | 90 | 11 | 120 | 15 |
| 30669 | 628_2 | 7.5 µM | 73 | 12 | 124 | 4 |
| 30669 | 628_3 | 7.5 µM | 88 | 2 | 115 | 4 |
| 30669 | 628_4 | 7.5 µM | 54 | 4 | 190 | 18 |
| 30669 | 628_5 | 7.5 µM | 64 | 1 | 138 | 3 |
| 30669 | 628_6 | 7.5 µM | 62 | 4 | 138 | 11 |
| 30669 | 628_7 | 7.5 µM | 55 | 1 | 138 | 13 |
| 30669 | 628_8 | 7.5 µM | 62 | 1 | 140 | 5 |
| 30669 | 628_9 | 7.5 µM | 79 | 10 | 134 | 22 |
| 30711 | 629_1 | 7.5 µM | 42 | 1 | 252 | 47 |
| 30711 | 629_2 | 7.5 µM | 40 | 2 | 295 | 30 |
| 30711 | 629_3 | 7.5 µM | 46 | 1 | 302 | 78 |
| 30711 | 629_4 | 7.5 µM | 41 | 3 | 260 | 16 |
| 30711 | 629_5 | 7.5 µM | 41 | 1 | 284 | 3 |
| 30711 | 629_6 | 7.5 µM | 43 | 0 | 262 | 1 |
| 30711 | 629_7 | 7.5 µM | 43 | 3 | 278 | 65 |
| 30711 | 629_8 | 7.5 µM | 53 | 5 | 234 | 24 |
| 30711 | 629_9 | 7.5 µM | 37 | 4 | 289 | 1 |
| 30711 | 629_10 | 7.5 µM | 47 | 6 | 292 | 6 |
| 30711 | 629_11 | 7.5 µM | 50 | 5 | 224 | 20 |
| 30712 | 630_1 | 7.5 µM | 44 | 2 | 282 | 22 |
| 30712 | 630_2 | 7.5 µM | 45 | 6 | 297 | 23 |
| 30712 | 630_3 | 7.5 µM | 46 | 2 | 272 | 10 |
| 30713 | 631_1 | 7.5 µM | 45 | 2 | 294 | 10 |
| 30713 | 631_2 | 7.5 µM | 42 | 0 | 285 | 14 |
| 30713 | 631_3 | 7.5 µM | 38 | 3 | 319 | 21 |
| 30713 | 631_4 | 7.5 µM | 43 | 3 | 282 | 4 |
| 30713 | 631_5 | 7.5 µM | 54 | 2 | 173 | 17 |
| 30713 | 631_6 | 7.5 µM | 37 | 0 | 315 | 10 |
| 30713 | 631_7 | 7.5 µM | 40 | 4 | 317 | 2 |
| 30713 | 631_8 | 7.5 µM | 44 | 1 | 275 | 5 |
| 30713 | 631_9 | 7.5 µM | 47 | 2 | 233 | 8 |
| 30713 | 631_10 | 7.5 µM | 108 | 18 | 101 | 3 |
| 30714 | 632_1 | 7.5 µM | 48 | 4 | 210 | 4 |
| 30714 | 632_2 | 7.5 µM | 53 | 5 | 256 | 5 |
| 30714 | 632_3 | 7.5 µM | 60 | 5 | 224 | 19 |
| 30714 | 632_4 | 7.5 µM | 89 | 12 | 117 | 11 |
| 30714 | 632_5 | 7.5 µM | 39 | 6 | 312 | 6 |
| 30714 | 632_6 | 7.5 µM | 40 | 2 | 278 | 31 |
| 30714 | 632_7 | 7.5 µM | 86 | 1 | 160 | 21 |
| 30714 | 632_8 | 7.5 µM | 57 | 17 | 278 | 40 |
| 30714 | 632_9 | 7.5 µM | 51 | 7 | 236 | 13 |
| 30715 | 304_2 | 7.5 µM | 53 | 5 | 206 | 18 |
| 30715 | 304_3 | 7.5 µM | 70 | 11 | 142 | 24 |
| 30715 | 304_4 | 7.5 µM | 88 | 1 | 120 | 10 |
| 30715 | 304_5 | 7.5 µM | 82 | 15 | 123 | 7 |
| 30715 | 304_6 | 7.5 µM | 43 | 4 | 264 | 12 |
| 30715 | 304_7 | 7.5 µM | 41 | 5 | 266 | 49 |
| 30715 | 304_8 | 7.5 µM | 43 | 1 | 291 | 12 |
| 30715 | 304_9 | 7.5 µM | 36 | 3 | 285 | 18 |
| 30715 | 304_10 | 7.5 µM | 42 | 1 | 280 | 40 |
| 33376 | 633_1 | 7.5 µM | 53 | 1 | 234 | 50 |
| 33376 | 633_2 | 7.5 µM | 45 | 5 | 301 | 7 |
| 33376 | 633_3 | 7.5 µM | 53 | 7 | 263 | 17 |
| 33376 | 633_4 | 7.5 µM | 53 | 4 | 229 | 22 |
| 33376 | 633_5 | 7.5 µM | 43 | 3 | 264 | 36 |
| 33376 | 633_6 | 7.5 µM | 53 | 5 | 247 | 12 |
| 33376 | 633_7 | 7.5 µM | 49 | 6 | 289 | 6 |
| 33376 | 633_8 | 7.5 µM | 64 | 11 | 238 | 24 |
| 33376 | 633_9 | 7.5 µM | 63 | 2 | 249 | 28 |
| 33377 | 634_1 | 7.5 µM | 57 | 9 | 250 | 14 |
| 33377 | 634_2 | 7.5 µM | 53 | 10 | 265 | 3 |
| 33377 | 634_3 | 7.5 µM | 48 | 2 | 275 | 10 |
| 33377 | 634_4 | 7.5 µM | 39 | 6 | 287 | 12 |
| 33377 | 634_5 | 7.5 µM | 49 | 1 | 255 | 22 |
| 33377 | 634_6 | 7.5 µM | 51 | 2 | 291 | 15 |
| 33377 | 634_7 | 7.5 µM | 47 | 5 | 297 | 16 |
| 33377 | 634_8 | 7.5 µM | 42 | 9 | 311 | 14 |
| 33377 | 634_9 | 7.5 µM | 47 | 5 | 271 | 23 |
| 33378 | 635_1 | 7.5 µM | 56 | 11 | 257 | 3 |
| 33378 | 635_2 | 7.5 µM | 56 | 5 | 213 | 23 |
| 33378 | 635_3 | 7.5 µM | 61 | 8 | 215 | 8 |
| 33378 | 635_4 | 7.5 µM | 58 | 15 | 232 | 16 |
| 33378 | 635_5 | 7.5 µM | 48 | 3 | 316 | 20 |
| 33378 | 635_6 | 7.5 µM | 59 | 5 | 262 | 30 |
| 33378 | 635_7 | 7.5 µM | 55 | 7 | 287 | 15 |
| 33378 | 635_8 | 7.5 µM | 42 | 1 | 284 | 3 |
| 33378 | 635_9 | 7.5 µM | 40 | 0 | 277 | 23 |
| 33379 | 636_1 | 7.5 µM | 50 | 2 | 239 | 7 |
| 33379 | 636_2 | 7.5 µM | 74 | 16 | 204 | 10 |
| 33379 | 636_3 | 7.5 µM | 55 | 4 | 201 | 3 |
| 33379 | 636_4 | 7.5 µM | 54 | 2 | 238 | 7 |
| 33379 | 636_5 | 7.5 µM | 52 | 5 | 207 | 43 |
| 33379 | 636_6 | 7.5 µM | 47 | 3 | 249 | 6 |
| 33379 | 636_7 | 7.5 µM | 48 | 5 | 241 | 1 |
| 33379 | 636_8 | 7.5 µM | 37 | 7 | 304 | 12 |
| 33379 | 636_9 | 7.5 µM | 62 | 9 | 245 | 5 |
| 33380 | 637_1 | 7.5 µM | 39 | 1 | 219 | 25 |
| 33380 | 637_2 | 7.5 µM | 59 | 1 | 197 | 11 |
| 33380 | 637_3 | 7.5 µM | 56 | 1 | 250 | 19 |
| 33380 | 637_4 | 7.5 µM | 53 | 7 | 244 | 36 |
| 33380 | 637_5 | 7.5 µM | 73 | 13 | 297 | 34 |

TABLE 8-continued

Oligonucleotide activity in patient derived human neuronal cell cultures.

| Start SEQ ID NO 1 | CMP ID NO | Conc µM | % of Mock UBE3A-SUP | sd | % of Mock UBE3A | sd |
|---|---|---|---|---|---|---|
| 33380 | 637_6 | 7.5 µM | 65 | 1 | 124 | 17 |
| 33380 | 637_7 | 7.5 µM | 74 | 5 | 133 | 5 |
| 33380 | 637_8 | 7.5 µM | 53 | 2 | 207 | 7 |
| 33380 | 637_9 | 7.5 µM | 54 | 15 | 226 | 26 |
| 39806 | 638_1 | 7.5 µM | 37 | 7 | 283 | 31 |
| 39806 | 638_2 | 7.5 µM | 49 | 11 | 291 | 30 |
| 39806 | 638_3 | 7.5 µM | 41 | 1 | 270 | 20 |
| 39806 | 638_4 | 7.5 µM | 42 | 13 | 267 | 9 |
| 39806 | 638_5 | 7.5 µM | 50 | 1 | 184 | 5 |
| 39806 | 638_6 | 7.5 µM | 38 | 1 | 276 | 15 |
| 39806 | 638_7 | 7.5 µM | 56 | 1 | 292 | 4 |
| 39806 | 638_8 | 7.5 µM | 41 | 4 | 267 | 11 |
| 39806 | 638_9 | 7.5 µM | 41 | 4 | 218 | 33 |
| 39807 | 639_1 | 7.5 µM | 48 | 15 | 293 | 30 |
| 39807 | 639_2 | 7.5 µM | 38 | 3 | 269 | 2 |
| 39807 | 639_3 | 7.5 µM | 72 | 5 | 167 | 3 |
| 39807 | 639_4 | 7.5 µM | 69 | 38 | 242 | 36 |
| 39807 | 639_5 | 7.5 µM | 47 | 6 | 303 | 36 |
| 39807 | 639_6 | 7.5 µM | 53 | 6 | 179 | 5 |
| 39807 | 639_7 | 7.5 µM | 51 | 3 | 189 | 8 |
| 39807 | 639_8 | 7.5 µM | 42 | 3 | 185 | 19 |
| 39807 | 639_9 | 7.5 µM | 45 | 3 | 202 | 15 |
| 39808 | 640_1 | 7.5 µM | 39 | 5 | 265 | 7 |
| 39808 | 640_2 | 7.5 µM | 37 | 4 | 272 | 56 |
| 39808 | 640_3 | 7.5 µM | 38 | 3 | 260 | 17 |
| 39808 | 640_4 | 7.5 µM | 33 | 4 | 255 | 2 |
| 39808 | 640_5 | 7.5 µM | 38 | 3 | 253 | 3 |
| 39808 | 640_6 | 7.5 µM | 40 | 8 | 216 | 10 |
| 39808 | 640_7 | 7.5 µM | 39 | 8 | 310 | 7 |
| 39808 | 640_8 | 7.5 µM | 41 | 6 | 282 | 21 |
| 39808 | 640_9 | 7.5 µM | 40 | 5 | 269 | 12 |
| 44439 | 641_1 | 7.5 µM | 35 | 6 | 336 | 32 |
| 44439 | 641_2 | 7.5 µM | 67 | 20 | 161 | 6 |
| 44439 | 641_3 | 7.5 µM | 34 | 9 | 317 | 30 |
| 44439 | 641_4 | 7.5 µM | 62 | 18 | 193 | 9 |
| 44439 | 641_5 | 7.5 µM | 34 | 4 | 280 | 3 |
| 44439 | 641_6 | 7.5 µM | 43 | 1 | 315 | 45 |
| 44439 | 641_7 | 7.5 µM | 45 | 17 | 307 | 53 |
| 44439 | 641_8 | 7.5 µM | 41 | 0 | 294 | 41 |
| 44439 | 641_9 | 7.5 µM | 37 | 2 | 334 | 43 |
| 44440 | 361_2 | 7.5 µM | 36 | 1 | 303 | 15 |
| 44440 | 361_3 | 7.5 µM | 32 | 3 | 315 | 12 |
| 44440 | 361_4 | 7.5 µM | 41 | 1 | 299 | 7 |
| 44440 | 361_5 | 7.5 µM | 40 | 5 | 295 | 6 |
| 44440 | 361_6 | 7.5 µM | 40 | 2 | 296 | 30 |
| 44440 | 361_7 | 7.5 µM | 39 | 1 | 300 | 55 |
| 44440 | 361_8 | 7.5 µM | 45 | 6 | 285 | 45 |
| 44440 | 361_9 | 7.5 µM | 44 | 6 | 321 | 26 |
| 44440 | 361_10 | 7.5 µM | 46 | 7 | 290 | 18 |
| 44441 | 362_2 | 7.5 µM | 50 | 4 | 277 | 4 |
| 44441 | 362_3 | 7.5 µM | 40 | 6 | 296 | 8 |
| 44441 | 362_4 | 7.5 µM | 37 | 5 | 340 | 18 |
| 44441 | 362_5 | 7.5 µM | 45 | 2 | 266 | 21 |
| 44441 | 362_6 | 7.5 µM | 39 | 7 | 263 | 0 |
| 44441 | 362_7 | 7.5 µM | 41 | 12 | 262 | 36 |
| 44441 | 362_8 | 7.5 µM | 35 | 13 | 313 | 6 |
| 44441 | 362_9 | 7.5 µM | 36 | 8 | 300 | 20 |
| 44441 | 362_10 | 7.5 µM | 48 | 10 | 293 | 1 |
| 46391 | 642_1 | 7.5 µM | 51 | 25 | 278 | 6 |
| 46391 | 642_2 | 7.5 µM | 46 | 2 | 303 | 4 |
| 46391 | 642_3 | 7.5 µM | 48 | 3 | 297 | 11 |
| 46391 | 642_4 | 7.5 µM | 45 | 11 | 320 | 37 |
| 46391 | 642_5 | 7.5 µM | 71 | 32 | 303 | 40 |
| 46391 | 642_6 | 7.5 µM | 47 | 15 | 298 | 16 |
| 46391 | 642_7 | 7.5 µM | 38 | 6 | 277 | 5 |
| 46391 | 642_8 | 7.5 µM | 38 | 3 | 280 | 20 |
| 46391 | 642_9 | 7.5 µM | 51 | 20 | 285 | 16 |
| 46391 | 642_10 | 7.5 µM | 32 | 7 | 293 | 20 |
| 46391 | 642_11 | 7.5 µM | 42 | 2 | 291 | 2 |
| 46391 | 642_12 | 7.5 µM | 40 | 3 | 317 | 19 |
| 46391 | 642_13 | 7.5 µM | 39 | 11 | 295 | 5 |
| 46391 | 642_14 | 7.5 µM | 52 | 20 | 295 | 16 |
| 46391 | 642_15 | 7.5 µM | 39 | 8 | 316 | 38 |
| 46391 | 642_16 | 7.5 µM | 35 | 2 | 294 | 30 |
| 46391 | 642_17 | 7.5 µM | 51 | 5 | 292 | 8 |
| 46391 | 643_1 | 7.5 µM | 39 | 4 | 276 | 16 |
| 46392 | 644_1 | 7.5 µM | 39 | 0 | 321 | 7 |
| 46392 | 644_2 | 7.5 µM | 46 | 4 | 308 | 4 |
| 46392 | 644_3 | 7.5 µM | 44 | 1 | 317 | 3 |
| 46392 | 644_4 | 7.5 µM | 38 | 6 | 315 | 11 |
| 46392 | 645_1 | 7.5 µM | 46 | 5 | 342 | 42 |
| 46392 | 645_2 | 7.5 µM | 37 | 5 | 292 | 25 |
| 46392 | 645_3 | 7.5 µM | 46 | 16 | 317 | 30 |
| 46392 | 645_4 | 7.5 µM | 47 | 8 | 381 | 102 |
| 46392 | 645_5 | 7.5 µM | 42 | 2 | 269 | 4 |
| 46393 | 646_1 | 7.5 µM | 49 | 4 | 295 | 2 |
| 46393 | 646_2 | 7.5 µM | 49 | 9 | 304 | 38 |
| 46393 | 646_3 | 7.5 µM | 44 | 6 | 298 | 50 |
| 46393 | 646_4 | 7.5 µM | 43 | 1 | 296 | 41 |
| 46393 | 646_5 | 7.5 µM | 35 | 1 | 260 | 3 |
| 46393 | 646_6 | 7.5 µM | 40 | 2 | 281 | 67 |
| 46393 | 646_7 | 7.5 µM | 38 | 1 | 278 | 44 |
| 46393 | 646_8 | 7.5 µM | 42 | 6 | 262 | 49 |
| 46393 | 646_9 | 7.5 µM | 38 | 3 | 289 | 24 |
| 46393 | 646_10 | 7.5 µM | 38 | 1 | 317 | 4 |
| 46393 | 646_11 | 7.5 µM | 42 | 1 | 320 | 34 |
| 46393 | 646_12 | 7.5 µM | 36 | 5 | 323 | 8 |
| 46393 | 646_13 | 7.5 µM | 41 | 3 | 262 | 27 |
| 46393 | 646_14 | 7.5 µM | 46 | 13 | 315 | 18 |
| 46393 | 646_15 | 7.5 µM | 42 | 4 | 340 | 27 |
| 46393 | 646_16 | 7.5 µM | 45 | 8 | 360 | 14 |
| 46393 | 646_17 | 7.5 µM | 44 | 1 | 303 | 3 |
| 46393 | 646_18 | 7.5 µM | 50 | 2 | 304 | 28 |
| 46393 | 646_19 | 7.5 µM | 54 | 10 | 217 | 25 |
| 51241 | 425_2 | 7.5 µM | 49 | 12 | 296 | 3 |
| 51241 | 425_3 | 7.5 µM | 48 | 6 | 297 | 10 |
| 51241 | 425_4 | 7.5 µM | 52 | 5 | 275 | 25 |
| 51241 | 425_5 | 7.5 µM | 40 | 6 | 284 | 29 |
| 51241 | 425_6 | 7.5 µM | 39 | 5 | 301 | 22 |
| 51241 | 425_7 | 7.5 µM | 39 | 4 | 263 | 13 |
| 51241 | 425_8 | 7.5 µM | 32 | 5 | 188 | 13 |
| 51241 | 425_9 | 7.5 µM | 42 | 5 | 286 | 2 |
| 51241 | 425_10 | 7.5 µM | 34 | 3 | 165 | 17 |

Example 6—Activity of Exon-Exon Spanning Oligonucleotides

Oligonucleotides designed to be complementary across exon-exon junctions of SNHG14-023 (ENST00000554726) were tested for their ability to reduce the SNHG14 transcript in the region downstream of SNORD109B (also termed UBE3A suppressor or UBE3A-SUP in the data table). Furthermore, the ability to induce UBE3A mRNA re-expression was analyzed. The oligonucleotides primarily span exon2 and exon3 (i.e. are complementary to a region in exon2 and a region in exon 3).

The oligonucleotides were screened according to the protocol for screening oligonucleotides in human neuronal cell cultures described in the section Example 5.

The results are shown in table 9.

TABLE 9

Oligonucleotide activity in patient derived human neuronal cell cultures.

| CMP ID NO | Conc µM | % of Mock UBE3A-SUP | sd | % of Mock UBE3A | sd |
|---|---|---|---|---|---|
| 674_1 | 7.5 µM | 47 | 2 | 214 | 12 |
| 675_1 | 7.5 µM | 44 | 6 | 265 | 10 |
| 676_1 | 7.5 µM | 44 | 3 | 284 | 16 |

TABLE 9-continued

Oligonucleotide activity in patient derived human neuronal cell cultures.

| CMP ID NO | Conc μM | % of Mock UBE3A-SUP | sd | % of Mock UBE3A | sd |
|---|---|---|---|---|---|
| 677_1 | 7.5 μM | 55 | 19 | 351 | 18 |
| 678_1 | 7.5 μM | 41 | 11 | 257 | 1 |
| 656_1 | 7.5 μM | 46 | 3 | 140 | 19 |
| 657_1 | 7.5 μM | 35 | 7 | 218 | 27 |
| 658_1 | 7.5 μM | 38 | 12 | 253 | 43 |
| 659_1 | 7.5 μM | 39 | 7 | 274 | 6 |
| 660_1 | 7.5 μM | 38 | 8 | 275 | 29 |
| 661_1 | 7.5 μM | 43 | 13 | 246 | 21 |
| 662_1 | 7.5 μM | 27 | 10 | 290 | 5 |
| 663_1 | 7.5 μM | 28 | 0 | 287 | 23 |
| 664_1 | 7.5 μM | 27 | 2 | 288 | 14 |
| 665_1 | 7.5 μM | 37 | 9 | 321 | 47 |
| 666_1 | 7.5 μM | 54 | 1 | 259 | 10 |
| 667_1 | 7.5 μM | 47 | 8 | 236 | 2 |
| 647_1 | 7.5 μM | 19 | 3 | 300 | 25 |
| 648_1 | 7.5 μM | 22 | 7 | 320 | 3 |
| 649_1 | 7.5 μM | 34 | 8 | 326 | 2 |
| 650_1 | 7.5 μM | 44 | 4 | 292 | 7 |
| 651_1 | 7.5 μM | 36 | 5 | 254 | 9 |
| 652_1 | 7.5 μM | 21 | 2 | 314 | 18 |
| 653_1 | 7.5 μM | 24 | 5 | 299 | 41 |
| 654_1 | 7.5 μM | 31 | 2 | 344 | 41 |
| 655_1 | 7.5 μM | 60 | 9 | 301 | 3 |
| 668_1 | 7.5 μM | 21 | 3 | 297 | 11 |
| 669_1 | 7.5 μM | 24 | 5 | 296 | 27 |
| 670_1 | 7.5 μM | 30 | 3 | 274 | 55 |
| 671_1 | 7.5 μM | 27 | 6 | 263 | 35 |
| 672_1 | 7.5 μM | 27 | 6 | 280 | 50 |
| 673_1 | 7.5 μM | 33 | 2 | 290 | 19 |

Example 7—Testing In Vitro Efficacy and Potency of Selected Oligonucleotides

Based on the screenings in examples 2 to 5 above 52 oligonucleotides were selected for potency and efficacy testing.

The oligonucleotides were screened in human AS patient derived cells as described in the Materials and Method section "Screening oligonucleotides in human neuronal cell cultures—96 well system" with the following modifications:

For UBE3a-Sense primer commercially available primers and probe from ThermoFisher: Hs00166580_m1 amplifying a 94 bp sequence in position 838 of refseq ID NM_000462.3 were used.

Each plate include PBS controls (instead on a non-targeting oligonucleotide) and the positive control oligonucleotides CMP ID NO: 186_1 and 39_1 identified in previous screens were included. The additional control oligonucleotides described in the materials and method section were not included. Oligonucleotide test concentrations were from 31.6 μM to 1 nM using a 10 point half-log dilution. All oligonucleotides were tested in 5 independent experiments in 5 different weeks. In the data QC process some plates were removed from the analysis if these were obvious outliers e.g. no PCR product detected. After this filtration there is a minimum of three independent experiments behind each the reported values.

The EC50 (UBE3A mRNA re-expression) and IC50 (reduction of the SNHG14 transcript in the region downstream of SNORD109B, also termed UBE3A suppressor or UBE3A-SUP in the data table) were determined after curve fitting using a 4 parameter sigmoidal dose-response model. Fitting was executed using the fit engine available inside the Biobook software by IDBS (XLfit). From the curve-fitting the maximum obtainable up-regulation of UBE3A (UBE3A Max Up) and the maximum obtainable knockdown of UBE3A-SUP (UBE3A-SUP max Kd) were determined. Both are shown as % of control (PBS treated cells). The results are shown in table 10, values are reported as geometric means of each biological replicate.

TABLE 10

Oligonucleotide EC50 and IC 50 values and maximum UBE3A upregulation and UBE3A suppressor knock down.

| CMP ID NO | EC50 ↑ UBE3A | Sd | IC50 ↓ UBE3A-SUP | Sd | UBE3A Max Kd | Sd | UBE3A-SUP max Kd | Sd |
|---|---|---|---|---|---|---|---|---|
| 586_9 | 0.02 | 0.02 | 0.01 | 0.00 | 329.4 | 25.5 | 33.5 | 3.8 |
| 585_1 | 0.03 | 0.01 | 0.03 | 0.02 | 301.6 | 18.3 | 31.0 | 5.3 |
| 572_7 | 0.03 | 0.00 | 0.01 | 0.03 | 294.1 | 30.4 | 31.3 | 3.5 |
| 591_1 | 0.03 | 0.02 | 0.01 | 0.00 | 387.3 | 46.0 | 41.4 | 2.8 |
| 585_8 | 0.04 | 0.02 | 0.02 | 0.01 | 312.3 | 23.1 | 35.2 | 3.3 |
| 626_7 | 0.04 | 0.02 | 0.02 | 0.00 | 362.5 | 44.6 | 38.7 | 3.3 |
| 621_2 | 0.04 | 0.03 | 0.02 | 0.01 | 264.5 | 19.6 | 24.7 | 3.9 |
| 624_3 | 0.04 | 0.03 | 0.04 | 0.03 | 288.1 | 19.2 | 29.7 | 5.2 |
| 169_52 | 0.04 | 0.04 | 0.02 | 0.01 | 303.4 | 23.1 | 27.3 | 1.8 |
| 624_5 | 0.04 | 0.07 | 0.01 | 0.01 | 249.2 | 16.3 | 16.4 | 1.4 |
| 586_5 | 0.04 | 0.01 | 0.01 | 0.00 | 364.4 | 43.9 | 30.4 | 3.3 |
| 626_8 | 0.04 | 0.03 | 0.01 | 0.01 | 338.7 | 24.0 | 39.1 | 2.6 |
| 169_50 | 0.05 | 0.02 | 0.02 | 0.02 | 280.3 | 23.0 | 28.3 | 2.4 |
| 572_6 | 0.05 | 0.01 | 0.01 | 0.02 | 298.5 | 22.4 | 36.3 | 4.0 |
| 639_5 | 0.05 | 0.03 | 0.01 | 0.00 | 327.7 | 22.0 | 38.2 | 3.6 |
| 592_2 | 0.05 | 0.03 | 0.02 | 0.05 | 364.9 | 27.1 | 36.4 | 3.6 |
| 586_8 | 0.05 | 0.03 | 0.02 | 0.01 | 366.6 | 35.1 | 38.0 | 3.9 |
| 625_6 | 0.06 | 0.03 | 0.01 | 0.00 | 335.5 | 34.7 | 32.5 | 1.9 |
| 644_3 | 0.06 | 0.04 | 0.01 | 0.02 | 298.5 | 22.0 | 25.3 | 1.6 |
| 586_4 | 0.06 | 0.03 | 0.01 | 0.01 | 354.3 | 31.5 | 33.0 | 2.3 |
| 642_12 | 0.06 | 0.05 | 0.02 | 0.01 | 289.2 | 14.8 | 24.7 | 3.0 |
| 572_5 | 0.07 | 0.09 | 0.02 | 0.00 | 312.7 | 25.9 | 31.5 | 3.0 |
| 592_4 | 0.07 | 0.06 | 0.03 | 0.01 | 341.1 | 31.9 | 35.7 | 1.8 |
| 622_3 | 0.07 | 0.04 | 0.02 | 0.01 | 300.9 | 21.0 | 27.6 | 3.6 |
| 622_5 | 0.07 | 0.01 | 0.02 | 0.01 | 306.2 | 13.5 | 24.4 | 4.0 |
| 616_4 | 0.07 | 0.04 | 0.03 | 0.02 | 293.8 | 17.9 | 29.1 | 5.0 |
| 304_6 | 0.08 | 0.08 | 0.02 | 0.00 | 318.1 | 39.2 | 43.8 | 3.9 |

TABLE 10-continued

Oligonucleotide EC50 and IC 50 values and maximum
UBE3A upregulation and UBE3A suppressor knock down.

| CMP ID NO | EC50 ↑ UBE3A | Sd | IC50 ↓ UBE3A-SUP | Sd | UBE3A Max Kd | Sd | UBE3A-SUP max Kd | Sd |
|---|---|---|---|---|---|---|---|---|
| 638_8 | 0.08 | 0.01 | 0.01 | 0.01 | 354.8 | 30.6 | 42.4 | 4.1 |
| 622_4 | 0.08 | 0.07 | 0.02 | 0.01 | 330.3 | 24.8 | 29.5 | 2.4 |
| 642_13 | 0.08 | 0.07 | 0.04 | 0.03 | 268.4 | 21.0 | 26.8 | 2.5 |
| 573_8 | 0.08 | 0.01 | 0.04 | 0.02 | 320.1 | 34.4 | 34.3 | 3.4 |
| 241_9 | 0.09 | 0.04 | 0.04 | 0.03 | 352.6 | 26.4 | 34.1 | 2.3 |
| 304_10 | 0.09 | 0.07 | 0.03 | 0.01 | 289.5 | 19.9 | 28.3 | 2.8 |
| 636_8 | 0.10 | 0.08 | 0.03 | 0.04 | 330.8 | 34.1 | 53.9 | 13.4 |
| 598_4 | 0.11 | 0.06 | 0.03 | 0.04 | 295.0 | 15.1 | 41.3 | 2.2 |
| 586_6 | 0.11 | 0.10 | 0.02 | 0.02 | 316.2 | 21.2 | 23.8 | 3.5 |
| 621_1 | 0.11 | 0.21 | 0.02 | 0.01 | 311.9 | 19.2 | 27.5 | 5.2 |
| 331_1 | 0.12 | 0.02 | 0.03 | 0.02 | 293.6 | 49.0 | 25.1 | 5.4 |
| 626_9 | 0.13 | 0.12 | 0.02 | 0.03 | 302.2 | 32.6 | 34.4 | 2.2 |
| 169_56 | 0.14 | 0.18 | 0.02 | 0.01 | 356.5 | 22.3 | 26.8 | 2.2 |
| 631_6 | 0.14 | 0.30 | 0.04 | 0.00 | 292.9 | 25.1 | 33.5 | 4.9 |
| 186_1 | 0.16 | 0.02 | 0.04 | 0.05 | 371.7 | 70.1 | 32.5 | 5.5 |
| 611_7 | 0.16 | 0.15 | 0.02 | 0.01 | 369.2 | 29.3 | 37.2 | 3.9 |
| 165_1 | 0.17 | 0.02 | 0.07 | 0.12 | 266.3 | NA | 26.7 | NA |
| 646_16 | 0.18 | 0.15 | 0.03 | 0.02 | 306.0 | 9.0 | 30.6 | 2.9 |
| 640_4 | 0.20 | 0.10 | 0.02 | 0.01 | 328.4 | 31.0 | 40.4 | 7.0 |
| 631_1 | 0.22 | 0.07 | 0.07 | 0.02 | 324.6 | 1.6 | 47.5 | 8.1 |
| 590_13 | 0.23 | 0.59 | 0.02 | 0.02 | 353.4 | 22.3 | 31.8 | 2.2 |
| 172_1 | 0.24 | 0.10 | 0.11 | 0.14 | 254.2 | NA | 34.2 | NA |
| 35_2 | 0.26 | 0.02 | 0.06 | 0.09 | 257.9 | NA | 22.3 | NA |
| 425_5 | 0.26 | 0.14 | 0.08 | 0.08 | 317.3 | 33.9 | 32.9 | 2.4 |
| 359_1 | 0.27 | 0.03 | 0.03 | 0.08 | 260.5 | NA | 31.3 | NA |
| 209_1 | 0.28 | 0.08 | 0.03 | 0.03 | 339.9 | 30.6 | 48.2 | 11.6 |
| 123_1 | 0.28 | 0.13 | 0.26 | 0.08 | 235.9 | NA | 51.8 | NA |
| 361_1 | 0.29 | 0.10 | 0.06 | 0.02 | 331.9 | 17.2 | 30.7 | 6.3 |
| 602_1 | 0.31 | 0.33 | 0.15 | 0.20 | 340.3 | 21.7 | 42.2 | 5.0 |
| NA | 0.44 | 0.12 | 0.15 | 0.18 | 251.3 | NA | 24.6 | NA |
| 287_1 | 0.45 | 0.09 | 0.04 | 0.02 | 318.1 | 45.2 | 28.8 | 9.3 |
| 303_1 | 0.46 | 0.05 | 0.09 | 0.15 | 259.9 | NA | 30.9 | NA |
| 379_1 | 0.47 | 0.02 | 0.08 | 0.16 | 247.2 | NA | 22.5 | NA |
| 405_1 | 0.48 | 0.42 | 0.04 | 0.01 | 323.0 | 56.2 | 32.5 | 11.9 |
| 39_1 | 0.51 | 0.20 | 0.06 | 0.06 | 341.2 | 30.3 | 40.4 | 4.7 |
| 206_1 | 0.52 | 0.07 | 0.14 | 0.31 | 262.9 | NA | 30.5 | NA |
| 155_1 | 0.53 | 0.10 | NA | 0.53 | 260.8 | NA | 26.7 | NA |
| 362_1 | 0.57 | 0.25 | 0.09 | 0.02 | 328.1 | 57.3 | 27.4 | 8.6 |
| 178_1 | 0.58 | 0.35 | 0.11 | 0.04 | 334.3 | 50.8 | 26.6 | 8.0 |
| 48_1 | 0.59 | 0.02 | 0.07 | 0.56 | 262.7 | NA | 27.2 | NA |
| 200_1 | 0.62 | 0.51 | 0.15 | 0.06 | 331.0 | 54.3 | 33.1 | 6.2 |
| 361_5 | 0.67 | 0.18 | 0.07 | 0.00 | 307.1 | 22.9 | 32.1 | 4.5 |
| 597_4 | 0.67 | 0.51 | 0.10 | 0.06 | 325.3 | 17.3 | 35.3 | 2.7 |
| 85_1 | 0.68 | 0.06 | 0.28 | 0.41 | 255.5 | NA | 35.1 | NA |
| 278_1 | 0.69 | 0.67 | 0.08 | 0.09 | 313.8 | 33.4 | 27.2 | 4.6 |
| 271_1 | 0.69 | 0.00 | 0.03 | 0.65 | 247.3 | NA | 24.0 | NA |
| 403_1 | 0.77 | 0.57 | 0.11 | 0.09 | 296.4 | 55.0 | 28.8 | 7.0 |
| 204_1 | 0.78 | 0.59 | 0.05 | 0.05 | 316.1 | 35.5 | 36.3 | 7.9 |
| 116_1 | 0.91 | 0.05 | 0.09 | 0.43 | 240.6 | NA | 31.6 | NA |
| 124_1 | 0.92 | 0.29 | 0.55 | 0.94 | 190.0 | NA | 43.9 | NA |
| 237_8 | 0.93 | 0.66 | 0.05 | 0.03 | 376.2 | 32.8 | 33.6 | 3.7 |
| 378_1 | 0.95 | 0.64 | 0.13 | 0.09 | 317.7 | 30.1 | 48.5 | 6.1 |
| 126_2 | 0.95 | 0.05 | 0.12 | 0.70 | 219.7 | NA | 45.0 | NA |
| 373_1 | 1.03 | 0.63 | 0.13 | 0.08 | 321.7 | 38.6 | 27.5 | 4.8 |
| 641_5 | 1.16 | 1.36 | 0.07 | 0.06 | 335.1 | 28.9 | 26.6 | 5.1 |
| 207_1 | 1.18 | 0.58 | 0.18 | 0.06 | 318.5 | 42.9 | 44.0 | 7.2 |
| 19_1 | 1.50 | 0.19 | 0.24 | 1.07 | 261.7 | NA | 28.4 | NA |
| 175_1 | 1.51 | 0.42 | 0.17 | 0.11 | 333.5 | 23.8 | 29.2 | 5.2 |
| 304_1 | 1.55 | 0.09 | 0.08 | 0.11 | 297.8 | 26.2 | 32.5 | 5.7 |
| 399_1 | 1.86 | 2.50 | 0.44 | 0.26 | 340.1 | 52.2 | 39.6 | 4.3 |
| 38_1 | 2.12 | 0.10 | 0.34 | 0.43 | 257.3 | NA | 45.1 | NA |
| 222_1 | 2.29 | 0.75 | 0.28 | 0.12 | 298.2 | 34.9 | 26.8 | 5.6 |
| 187_1 | 2.30 | 1.39 | 1.00 | 0.91 | 315.3 | 38.4 | 28.6 | 6.2 |
| 272_1 | 2.32 | 1.39 | 0.24 | 0.16 | 330.4 | 41.2 | 37.1 | 6.1 |
| 18_1 | 2.42 | 0.21 | 0.24 | 2.00 | 271.0 | NA | 29.3 | NA |
| 118_1 | 2.78 | 0.30 | 0.31 | 0.07 | 205.4 | NA | 40.4 | NA |
| 35_1 | 2.93 | 4.94 | 3.61 | 1.52 | 258.4 | NA | 48.2 | NA |
| 233_1 | 3.14 | 1.68 | 0.35 | 0.16 | 330.3 | 20.1 | 29.3 | 5.2 |
| 220_1 | 3.47 | 0.99 | 1.02 | 0.48 | 315.5 | 27.4 | 29.6 | 7.6 |
| 33_1 | 3.97 | 0.41 | 1.07 | NA | 265.7 | NA | 32.2 | NA |
| 109_1 | 4.06 | 1.45 | 1.33 | 0.67 | 231.7 | 44.7 | 39.6 | 3.9 |
| 40_1 | 4.17 | 0.05 | 0.12 | 3.74 | 263.6 | NA | 38.3 | NA |
| 115_1 | 4.98 | 0.15 | 0.25 | NA | 184.2 | NA | 47.0 | NA |
| 161_1 | 6.55 | 3.20 | 1.25 | 1.24 | 294.0 | 24.8 | 32.1 | 7.4 |

TABLE 10-continued

Oligonucleotide EC50 and IC 50 values and maximum
UBE3A upregulation and UBE3A suppressor knock down.

| CMP ID NO | EC50 ↑ UBE3A | Sd | IC50 ↓ UBE3A-SUP | Sd | UBE3A Max Kd | Sd | UBE3A-SUP max Kd | Sd |
|---|---|---|---|---|---|---|---|---|
| 105_4 | 6.61 | 1.62 | 1.38 | 4.20 | NA | NA | 50.6 | NA |
| 19_2 | 6.66 | 1.17 | 3.17 | 1.52 | 201.7 | NA | 57.7 | NA |
| 104_1 | 7.75 | 6.77 | 1.67 | 1.05 | 267.9 | 25.5 | 42.5 | 4.1 |
| 18_2 | 20.00 | 1.67 | 3.50 | NA | 245.9 | NA | 46.4 | NA |
| 108_1 | 20.00 | 0.61 | 1.27 | NA | 219.6 | NA | 51.2 | NA |
| 129_2 | 20.00 | 0.08 | 1.10 | NA | 165.8 | NA | 56.5 | NA |
| 141_1 | 20.00 | 0.03 | 0.15 | NA | 159.0 | NA | 64.1 | NA |
| 142_1 | 20.00 | 1.04 | 1.12 | NA | 133.1 | NA | 57.6 | NA |
| 145_1 | 20.00 | 1.30 | 1.81 | NA | 139.0 | NA | 56.9 | NA |

SEQUENCE LISTING (846 sequences)

SEQ ID NO: 1 - DNA, 141053 bp, Homo sapiens
agatgtgcggccctccaataggacaaataagactctcagagcctggctctatttggggatccctcagtgacaacatagtacccctgtgagcgtgccttttctatctcttcgaagagggcagtggcatcctgtcttatgagtcagtgtgcactttagtgtgcctagtgacccaagacttgctttaattgtagatagatacttacatataggaaatatttcttaagtaacaaatgaaaaactttagaagattgaattaagggtcaagcaactgtgatatgtctgaaaatctcattagtgttgtgctgaaagaaggaaatatggcatgcctctattaaataatgacagtggaaccaagtttattgctttgttatttttactgtggagtattttctaagattatttttgctttttttttctttcatgttttgctgagatagaaggcctggaatctgatcctccacttcagagaacaggggtgagtagctaagccattatcttttgaaattcatatgtcatgtgctctttgctaggtctttaggtcgttttgtacatcttttcagaagcttattggaggacattttcatgatatgtccttttcctcattgagaccctcaccatgtcacctacactattgaatccttatcatttctcttttaattttaactctcttttgcttttatggaaaaatgtagaatttaagagaatttttggcaatttcatattggatcaaaatgtattgtagtgaaatccaggtgtgccaaaatattaacagattttccccatctgtttaattattggggtttcagaatagagactccatggttcataatatctttgtggtcatactacattatatttctgcttctaatttaattattaaatattgacttgaattagtcttttcctcattgttgcaacaaggtaagttatataggaaattttcttctcttgatggcatgtctgagataatcatagatataagacacctggctggtttctagaatgcatgtaatttttatttcttgatctgtgtgttgagtacttgctgtgattgcatcatgcaaatacattgagctttacaattttagtgtatgcacttttctacatgtatattattcttcgatagaaagtaaaaaaaacttatcgaactagtcaaaatattggttaatacataaaaaaagtctcaagtagattgtgtattacatggtgcttgttgattgatgccctcataatagatcaagtgggttctctctttagcacagggctttttagcaaatcatgtcatgagtagttactcaagtatttttattttaacacatttatattttttctatgtatattcttaaattctcttatacttttttctctgttataaaaacatgctgaacaatctcaagtcttaaggattgcagtattgtccccacatattcatgtattttggtactcaattctttatactttctttgacagatcacttgaactggcacatgtctcttgttttgcagagagggaattaatgtgataccttcatgcttttctattctatgtgctacataattgaatatacaagcaaatatagttgttaagatttagtgtgattatttctacaccacatgcaaagaagtttctcatagatcttaatagaggcccacatgcattgtacagtttagaatttggggaaatattgatgaagttgggtaaagtataaagccaaaagtcagaacagtgaactccttgcttaaggatttccttggagattacttagtcaatacacaactgataaatttaagtgcttttcaccttttgagttctcgacatactaaagctaaaatgtgtttcaacttttaatcctgcttccctgattttcccttttttagtctgagatcaaagagtttcagccataaattactgccaagagtaatcacttcattttaagaaagcttaacaatatagaagaatataaaattatttatgacagatgtatttttaaccttttccccatgctttccagaggaaatatgtttaatcatctgccctatattagggaaaaactttctatgctaatacaagtatctatcaatccatttatctttctatataagatgtattgatcataaccaattaactttactgtaaatgagctttagatttgacattttggtagtaatatatgttgtacaatctcctgaggtcctataggtcttgaggtctctatgtcaaaaactatagatgtgccagtgtcctcagtgaatgtgaaggacaccacattttccttagccatttcttgttttcagaataatggttatcaacattttgctactgcaagataccatacatttataatcggaatatgccagtttttatgcactcatgcctctgtttctgtagagcattcccagaatgagtaatgcttgaaaattaggtccatgtgatttctttaatgagttatagtcaaatcatgaaatattcaggttaccattatttcagtaatgtattagaatgtcaaggtaaagttatctacattgtatatatacacacaacatagatataatttatacaacatctatatttatacaacagatatatatttatgtatatatttatacaacataaaatatattttattatttaaacataaaatatattttattatttaatatagattcttaagtgataaatatgtttaatattattaaaataggttaaaataggttatagttagtacagtgaaaattggcagcccttttacaaaacatatgccataactatagcatttatcactgacagtcataccaggatagtcttttatttccaatcacttaaatattcctaattgcaaaagaaatttgaagactaaaattcagaagttttgaaagagccattgcctgggtaaactatacaggtttcagttttatttataataattatgaggccaggcgcagtggctcacacctgtaatcccaacactttgggaggccgaggcgggtggatcacgaggtcaggagatcgagaccatcctggctaacacggtgaaaccccatctctactaaaaatacaaaaaattagccgggcgtggtggcgggcgcctgtagtcccagctactcgggaggctgaggcaggagaatggcgtgaacctggtaggcggagcttgcagtgagccgagatcgcgccactgccctccagcctgggagacagtgcgagactccgtctcaaaaaaaaaaattatgtatatatttataaattaatacttaataaattaataacttgtgataggcaatgcaaagatgacagtaaaaggacaaaattgattagattgataaagtcctgttaacatgaagaaattgaccaggataccatccacactataaagttagagaaatttatcaggacaattccctaaaatactcttctcaattttaacattgtaacaggaatttttaaaattttggtattatgtgtgtttccttccagataatttgaacagattcatatttggtatttttaaaagccatatctttgtccttagtgctggcaatgtattcttgagaatgaacaaataagagatacgtaaaagcataagagaaggtatcaggttgaagtagtcaatcagttatacagaacacaaagaattttatcttgtataatgtttatatagctttatagaagtgtgctgaaagggctataaaacatggacattattatctcattgaaaggtccaatacgtactgaaatacatgcttttattttgaaccaaccaccctataaacgttgtatggcttatttagatgagagcccaggttgtgtgtgtctgtgtgtgtgtgtgtgtgtgtgtgtgtgtgtgtgtgtgtgtgtgtacctgacagggaagcaagaacatcgagttgccaatgcactctgtctatggttagaatcatgctgaaaacatggctcccccagttctggaatgagcccacagatcaagcattccccaaagacatagcaggctcaaatccctgtgtacacaatattttatgattatcttatgtcagtactttcaaagtatacagtttgtgtgaagacaaatccaatgtcatttttcttggctagcctatatgtgtggtaaatccattatttacttacttgcttcctgaaaattacaattagattaacaaactgcagcaaagtgggcatgatgagatagagattgaagtgtaagcttatgttaatgatgcccttggtttggataaacacatctaagagaaaaatggaaaaacacacatggcagggaagccttgatagagccaaaatataggattgtatgtagtaatgcaatccatagatgagcatttggcagtaatattatttttcagatatggataaaaattgcttaggagagtaaagagagacaaagttgaaagcaggtttatagtaggtgttgttttagtgttgatccctttttgctccaataatcaaagtgataaatattgaaaattgattcatgcagcattacttactccattctaatttttatatatgtcaaaagtgccatctcccaaactgtgctatccccttcaggagaagagactctgctgaagtttataaggttgacatattgccagcttcaataatgtaaagatgaagtgtatactgaattcttaatgcaaataacaactctattggaaagtaacccagttatagaagtgctaatttgtcaggagctgccttaccaagatcatgatgagtacagttatctcaggattctgaaagattgttttccgatttcaactagtctagctgaatgttccttgatagaaagagaggacttttagaattggttcaatatgatgacctcctgaattatctcacatagcccgtttgtacatgcctttcttttctctcagaaaatggcactatcataatagctttcttacacagacttcaccttagggttttacattaagggaggggtctggtgtttcatttattttgaagtatttgttgttgattgtgtacagtgcttgagtaaaaaattgaatatagaaacatctagaatatttttttaaaggatcagtgtttataaagtgaattattagtgtcaataatgttgggaaagttttaagagaatataggaaacttgaacattacacaactacaatgggaccaaattgtggggtctcattatagttaatatttatgtatttttttccaattgatttgtgtgctttttttctgcatgtttttggcagatagaatggctataacaagtaacagcatgtcaggtaataaaaataagcagagccctattcctttaaaaatcttcactgatgggagggccataaaataagtcttaatacatttaaagaattaaattcatgtaaaccatgttaatttaattccacaatgatattgaattagaaataagaggaatatctcttgaacatctcctaaatgtttggaaatttaaattagcatttctgacctatttattggttaaaaaagatacaaagaaaggaaaattgaaaagtcttttgaactgaataaaaataaaaatatagaatctaaaactttatgggatactgacaaaacaggatatagggaataatttatagcactgaaatgcctatattagaaaagaaaaaaggttttaaatcagtaaatttgtattttaccttaagaaacttagaaaagaacaaattaacccagacttaagtaaaataaaggcactaataaagataagagcagaaatcaatgaaatataaaacaacaaaacacagagaaaaattgagaaaatttaaaaatagcctagtgagaagatattgataaacttgtaaccagaccaatttaagaaaaaaagtcaaaacacaaataccaatatttgaaaatgtaggagggcaaatcattacagattctatgaatactaaaatgataataaggaaaaattatttaaaaggggcatgtcagccaggcatggtggcttacccctgtaatcccagcactttggcaggccgaggtgggaggattgctagagctcaggcattcgagaccagcctgggcaacatgttgaaaccttgtctacacaaaaagtacaaaaattagctgggtgtggtgttgcacacttgtagtcccagtcacttgggaggctgaggcgagaggatcacttgagcccaggaggttgaggctgcagtgagccatgtttgtaccactgccctccagcctgggtgacaaagtaagaccctatgtaaaaaaaaaaaaatgtatgccaacatttttcaataacttaaatgaaatggaaaaattccttgaaagacacgaactacaaaaactcagtgaacaagtaaataacctgaatagccctgtatcaagtaaattgaatttgtagttaaaagccttccaacagagaaaacttcaggtacctatagcttcatatgaaatgaaaaaaaaaataccaatcctctacaagattccagaacatttaaaagaagggaatatttcccaacttattccatttggacagcaatacccaggtaagaaaaagagacacagaaatttaaaaagaagaatatacattattccttaggaacataaatgcaaagaaatctaatcaaaattttggcaaatgaaatgtagaaatactttatgaccaagtgagagttacccaaagaatttaaggttggttttatatgtaaagatcaaccaatataggaaaatcacttctggaaagtcagagtaagaaactccaaaaatctactcctccataaaaccaataacagccttgatagaaatagttgaaattaattttccaaaactttggaaattaaccaaaggcttacaaaattccagagaacattaattcaagaaaaatggctgaatcagtaagaacagccagctttgtggcattttaatatgaccccttcccatgcttttctccctagtgctgagatagtcttaaaaattagcaggatagcaaccactggagaagaaaggtttggaaatttcccaaaaagttccatccccatagaattatcactatttgacctctaaagcccaatctataggatttatattcatttggactgactcagagctcactcagtaaggaaatctcaatttcaaggtattggtcaaaaagaatccatggcaattgttgactatcacaactgcctgaagtcttggtaacagttgggataaacaagaagctgatcaaaaactgaaaactaaaatcttgggaatgagatatctacaggatgcttcaaaaagctttgatacattcctgtttatctagaaagctacatgcaggctgggtgcagtggctcacacctgtaatcccagcactttgggaggccgaggcgtgcggatcatgaggtcaggagtttgaggccagcctgaccaacatggtctctactaaaaacacaaaaattagccaggcgtggtggcgtgcatctgtaatcctagctactcaggaggctgagacaggagaatcgcttgaacccgggaggcggaggttgcagtgagccaagattgtgccactgcactccagcctgggcgacagagcaaggctctgtctcaaaaaaaaaaaaaaaaaaagccacatgcatgtaattgtttacctctggctttccttttatgctctgggcaagctaaggaagagttgtgaactacctaagtgctgaatgggaaccataacacacacacacacacacacacacacacacacagcaccttagtaaagggtgagaggcatgttagttagaagcattaaaggaaatctctttctagtcattatctgtgcactaacctaactgagcagagacttcagtatccacatactacagggcatataaactttacagaattagtccaggaaaatcatatctaaaaaaaaaaaaaagcagtaacaaaaataaactctgggaaaggggagaatatgatttaaagagttgccacattatacataatatgtctagtgttcaacaaaaaattacgagacatgcaaagaaatagaaaaatatggcacaaagaggataagatgaagtcagtgaaactatcctcgaggaagaccagatgttggtcttactagacacagacattgaaccagctattaaaaatacgtacacagaactaagaaaaacatgtcaaaagggttaaagaaaggtataaaaatagtgtcttaccaaatatagactaccaataaagagatagaaattataagaaaagacaacatgaaaaaatataaagcaaaaaaattagacaattgaaacaagagggcctctattcgcagatttgagcaggcagaagaaagaatcagtgaacttgaagatatgtcaactgagattatccagtctgagcaacaaaggtgggaaaaaatgaagaaaactgagcaacaaagaactgtagaacagcatctctcataccaatggatacataaactggagccctagaaggatgaaaaaaggagaaggaaagaaaacttcccaaattttaagaaaaacattaatttatatacccgagatgaccaataaaatccaattaagataatctcaaagagaccaacacctatacacatcatagtcagcgtgtcaaaagacaaacataaggagagaattcttgaagatagtaagaaaaaaattattcataacatacacaccatcctcaataagtctgacaattgacttctcactgtaaaccatgcaggctaaaaaggcaatgtacataaccaaagtgatgaaataaaaaccttcaaccaatcattctagatccaacaaaactattgttcaaaaagaagaaatgaagacattcctaaacaaaatctcagagaaatgttctctataagacttgtcctaatagaaatgctaaaggaactccttcggtctgaaatagaaaggcactggagagtaaatcaaatccacgagaagaaataaagagaaccagtataagtaactacatgtgtaagtttaaaacaaagtataaatttattttgtttgtaacatttgtcttttcctatttgatttaaaatataatctcaattataaacttgtgttgatggtattatataaagatgtaattttgggttatagcaccaaaatggcagaataggaattttctgtaggtgtttcccacataagtatcaattttgacaaccatccatgggcaagagtaccttgtgggagttcaggagttgacagtaaaacttcagcacaccagaggagtaaagaaatctaagaatagattcattggaaagggtataaacagtttcactttacctgcatcaccaacccccaaaagtggcacagctcagtaacaagagcccattatttcttccacagaggaaaaggagagtataataagtaagtgtccagtttctcaagacatacaggcccctgcccaagagatccactttattttcatctcacccagaatattgaggtgatcagcaaggtggagtggttgggagagggtaaaagcaggaaagagagatggggactcaaacagcagcccatacttggaactgccatagatcctaccagttacttcatggactccatcaggaacccacctataagccacaggggatgcatccctcccatcttgccaacaaaaccccgaatgctccaaatgcctcacccactctttggctggctcccaagtgcgctcctgtgaaaagcgagtgagtatctctgcagatggcttgcaagcacatgttgacagctggctccactctgtagaactggaaaaaagctcacatacatgagaatttcaggacactaccctaaaaaaaaaaatgagacttcagcacctggcctggctttatgcaacctagagaaggtgatatgatttggctctgtgtccccacgtaaatctcatgtcaaattgtaatccccacgtgttggacaagggacttggtgggaggtgattgaatcatgcgggtggacttccctcttgctgttcttgtgatagagttgttatgagatccagttatttgaaagtatgtagcatgtcccccttcactctcttgcactcctgctccaccttggtaagacttgcttgctacccctttgccttctgccatgattgtaagtttcctgaggcctcccagctatgcttcctgtatggcctgcagaactgaactgtgagccaattaaacctcttttcttcataaattatccagtcttaggtagttctttatagcagtgtgagaatggactaatgcagaaggcatacaacctttagaatttgcccccttgagggaacaagatgtgtgaagcaggttcatccatagaaaatgtctgagagaacctcaaaatccctaacctgactaactgatgaaagtgtttctctcctaaggccagtcagtaaagaccagagggggtgactgtttctttaaatgcaaaggcagcagcacaataattcaagaaacatgaaaaatcaagaaaacatgacaccaccagaagaacacaatcattttccaataaccaactccccaaaaatggagatttacaaattggtttataatgaattcagaacaattatgttaaggaagctcagcaaactaaaaggaacaccaatagactactctgtgaagtcaggcaaacaattcatgaacaaaactagaaattcaaaaaagagaaaaattatcttaaaagaaaacccagaagttatggagctaaagaatacaatgcatgaaatgaaggagcgtatcaacagcaaagttgatcaagcataagaaaaaaaaaatctgtgaaactgaagactggctatttgaaattattcatcagaggattaaaaaaaaaagaatgaaaagaaataaagaaagcctacaggatgtataaaacaccatcaagagaactaatataaggattattggagtcataaaggagaagagagaaaagggtagaaaacttatttaagaaataatggctgaaaactctccaaatctaggaaaagatatgagcatccaggtatatgaagctcaaagatccccgtacaggatacattccaaaaagacttcaccaaaacacatgataatcaaactgtcaaaagcaaaatcaagacgatgaataaaccaccaatcactaagagggagacaggattcttatgttgtcattattatttacatataatttcagtaaatgttattggaaaatttataatgttttaaaaaaagaaatttgaaagcaccgaaagaaaagagactcatcacatacagggaacccttttaaggcattcaagagatttctcagtagaaaccttacaaaataggagagagtgggatgaactatacaagtgctgcaaggaaaaaaatgccaaccaacgctttacctggcaaatctgttcctcagaaatgaaggagagagaagaactttcctagacaaacaaaagctgaggcagttcatcaccactagacctgccttacaagacatactaaggggagttcttcaagctgaaatgatatggcaatagttagtaatatgaaatgataaacctcactggtaaaggaaagtacatagtcaaatttagaacactttgatactataatgatggtgtataaataattttactgtgctatgaaggttaaaagacaaaagtattaaaaaaaacccatagctgcaatagcttgtcaatgcatactacagtataaaaagatgtaaattagaacattaaaaacatagcatgcaagggtagggaagtaaaagtgtagttttcatatgtaatcaaatttaatttgttatcagcttaaaataaattgttatacctatgttttatgtaagtgtcatggtaactataaaggaaaaacctctagtagatacacaaaagaaaaagagaaaggaatcaaaacataacactacagaaaattatcaaattacaaaggaagacagcaagggaggaacaaagtaaaaagagcaagaaaaaatttaacataatgaaaacagtaagtccttacgtgtcaataattactttaaatgtaaatggattaaattatccaaacaaaaaaacagactggacaaatggattttagaaacaacaacaacaacaaacaccgcacacacacacacacacacacaaaccacccagccccaactatgtgctgcctacaagagatttacttccactttaaggacacatacaggctgaaattaaaagaacagaaaaagatattgcatgcagatagaaaccagaagagaggagaggcatctatacttacagcatacagaaaagattttaagttaaaaactatatcaaaaggctaagaaggtcaaaatggtgaagcagttaattgttcaagaagacataaaaattgtaaatatttatacacccaatattgaagcacctaaatatataaggcaaatattaatacatataaaaggagaaatatacagcaatacagtaatagtagtgaacttcagtgcctccctttcaaaaatggataatccagacataaaatcaataaggaaacatttaacttaaacttcactttagaccaaatggatctaacagacattatactgaacatttcatccaacagtggtagaattcacattcttctcaagcacacatggaacattctccaggatagattatatgttagctcacaaaataatattacaaaatttaataaagctgaaatatcaattattttgcaccacaatagtataacactagaaatcaataacaagatggaaactggaaatttacaaatatatagcattaacatattcctgaacaaccaatgggtcaaagaaaaaaatcaaaataattttgtgacagcaaagtagaaacacaacataccaaaacatacaggacacagcaaaagcagttctatgaggtaagcttatattgataaacacatttaaaaaaagattttaaataaacaacattacacctcaaggaactacaaggaagaaaaaaaaacaagccccatgttatcaaagggaaggaactaacaaagatcagacagaaataaatgaaacatagactagaaaaacaatagagactattaataaaacttagagttagttttttaaaaaataaaatcaacaaacctttagctagactaaaaaaagagaagactcaaataaaataaaaaatgaaagaggagacattacaactgataccacagacatacaaattaagagaaaactatatgccaacatattagttaacttgcaatgggtaaatccctagaaacatacaacctacaaaaactgaatcatgaagaaatggaagatctgaacagatcaataatgaataagggaattgaatcaatattcaaaaatctcacaaaaagaaaagctcaggatcagatggcttcactggtgaagactgccaaccatttaaaaaaattaataccactctttattaagctcttccaaaaaaattgaagaggagaaaacactttcaaattcattataagaggccagttttaccttgatatcaaagatttaaaaagaacactttgagaaaggaaaattacaggccaaaacccttgataaatatagatgcaaaaatgctcagcaaaatactagcaaacctaattcagcaacacattataatggcatacatcatgaccaagtgagattcatgcctcggatgcaggatagttcaatataatcaaatcaacaaatgttacactactttaacagaatgaaggataaaaatcatatgatcatctcgatggttgaactagtttacagtcccaccaacagtgtaaaaatgttcctatttctccacatcctctgcagcacctgttgtttcctaactttttacagatcaccattctaactggtgtgagatggtatcttattgtggttttgatttgcatttctctgatggccagtgatggtgagcatttttcaagtgtctgttggctgcataaatgtcttcttttgagacgtgtctgttcatatccttcacctactttttgatggggttgtttgtttttttcttgtaaatttgtttgagttctttgtagattctggatattagccctttgtcagatgagtagattgcaaaaattttctcccattctgtaggttgtctgttcactctgatggtagtttcttttgctgtgcagaagctctttagtttaattagaccccatttgtcaattttgtcttttgttgccattgcttttggtgttttagacatgaagacagtgtggtgattcctcaaggatctagaactagaaataccatttgacccagccatcctgttactgggtatatacccagaggattataaatcacgctgctataagccataaaaaatgatgagttcatgtcctttgtagggacatggatgaagctggaaaccatcattctcagcaaactatcacaaggacaaaaaaccaaacaccgcatgttctcactcataggtgggaattgaacaatgagaacacatggacccaggaaggggaacatcacacactggggatggttgtggggtggggggaggggagagggatagcattaggagatatacctaatgctaaatgacgagttaatgggtgcagcacaccaacacggcacatgtgcacatatgtaacaaacctgcacgttgtgcacatgtaccctaaaacttaaagtataattaaaaaaaataatgctgctataaagacacgtgcacacgtatgttcattgcggcactattcacaatagcaaagacttggaaccaacccaaatgtccatcaatgatagactggattaagaaaatgtggcacatatacaccatggaatactatgcagccataaaaaagatgagttcatgtcctttgtagggacatggatgaagctggaaaccatcattctcagcaaactatcacaaggacaaaaaaccaaacactgcatgttctcactcataggtgggaattgaacaatgagaacacttggacacaggaaggggaacatcacacactggggcctgtcgtggggtcagggtagggggagggatagcattaggagatatacctaatgtaaatgacgagttaatgggtgcagcacaccaacacagcacatgtgtgcacatgtaccctagaacttaaagtataataaaaaataaatcatatcatcatctcagtagatttagaaaagcatttaacaatattcaacatcctttcagaactaaaaactctcaataaatcaggtatagaaagaatgtgcctcaacactataaaagccacatatgacaaacctggaggtaatatactcaatggtgaaaagtaaaaagctttgactctaagatcagaaccaaaacaaggatgtccattctcaccacttatatttaacatagtagttgaaattctagctagagcaattaggcaagaaaaaaggcacccaagttggaaagaatgaagttaaattgtctctgtagatgacatgatcttatatatagaaaacactaaagactccaccaaaatgctgttttaattagagcttaaaaaaataattcactaaagttgcaggatacaaaatcagtatacaaaaatcagttgcatttctaaacaccaaaaacaagttatccaaaaaattaagaaaacaatcctatttgtgatatcatcaaaaaataaaatactaaagaataccaaagaaactgaaaataaatggaaataaatggaaagatagcccatgttcatggattagatgaattaatactgttaaaatgttcatactacccaaagcaacctacagattaagtgcaattcctactaaaattccaatgacatttttcacagaaatagaaaacacactcctaaagtttgcatggaaccgcaaaagactcaaatagatgaagcaattttgagcaagaacagtaaagctggagacatcacactacctaacttcaaaattttattaatcaaaacagcatgacataaaaacagacagaaaagaccaatggaacagaatagagagcccagaaataaactcacgtttatagagtcaactaatattcaacgaaggtgccaagagtacacaatggggaaagtatagtctctacaataaacagcactgggaagacaatatccaaatgcaaaagaatgaaattacacccttatcttataccatacacacaaatcaaatcaaaattgataaagacttaaatataagacctgaaaccatacaatctttaggcaaaaactcattgacattggtcttggcaatgatttttttgatatgacaccagaagcacaggcaacaaaagcaaacctaaacaagtgggaccctaacaaactaaaaagtttctgcacagcaaaggaaacaatcaatcatcagaattaaaaggcaatttatgaaatgggagaaaatgtttgcaaaccacatatctgataaagggttaatatccaaaaatatataaggaatgcataaaattcaatagaaataaacaaacaaataatccaattttaaaatgggtgaagaacctgaatagacattttttcaaagaagacttacagataggcaacaggcatatgaaaaaatgcttgacatcactaataatcagggaaatgcaaatcaaagctccagtgaaataccacctccaactattaggatggctattatcaaaaactcaaaagaaaacaagctgggggaatgtagagaaaagggaaaagaagatccttatacactgttggtgtgaatttaaactggaatagcccttatggaaaacagcatggaggttcctcaaaaaattaaaaatagaactactatatgatccagcaatttcactattgagtatatatccaaatgaattaaaatcactgtcttgaagaggtatttgcacactcatatttatttcagcattattcacaatagccaagacatggaatcaacctaagtgttcatcagtagatgattagataaagagaacgtggtatatagacacagtggaatctatttagtgttcaaaaagaaggaaatccaacttttaaaatcctttaaaaagttaaactcataaaaacagagaggagaatggcggtttccaggaactggagggtgggagaatggggagatgttggtcaaaaggtacaaactttcagttataaaatgaataagttctagagatctagtgtacaacagcattactatagttaataataatattttttatacttgaaatttgctaagagtaaatatcaatattctcaatacacacaaaacagaactatctgaaggcactgatatgttaattatcttcattatagtaatcatttcacaatgtataatgaatatcaaaacaatagtgtacatcttaaatatatacagttttgatttgttaatcatacatcaatgaagctagaaaaaatgttgtaatttttaaaacaatagtaatataaattaggggtgaaggaattgacctatgttggagaaaagtttttgtaaactatttaaattaattggtatccattcaagctagattatttttaattgttaatttaattgtaatactaaggcaaccactaaaaaagcctttaaaaaaatatagcacttgaggctgggcatggtggccctcaattatatatataatatatataaaatatatattatatatatagtagatgaacaacaatgggatttaaatggtacactagaaaatatctgtttaacaaaaagaaagcaatagtggagaaatataagaacaaaaccatgtaagatttatagaaaatgaatagcaaattggttgacctaaaccctatcttataattatattaaagataaatgaaataaatactacatcaaaaggcagagattatcagaatagagaagaaaaatccaaaccataattcaaccttatgttatctgtatttagaatatttagagtcaagacacaaatagatagagttccatttgggcgtgaaaatatttaccatgcaaaatgtaattaaaatagagctagagcagcaatactaatatctgacaaaatatactttaacaaaaattgttgctaaagacaaaaaagaacattttataataagacacaacaattataaacatatacaccaaacaatagagcccaaaatatacaaagcaaaaactgctagaattgaagaaagatagaaaaatcaatgattacagttggaggtgtcaataccaaactttcagtaatacacagaacaacaagtcaaaagcaaaaaggaaataaaaaactacacattatcatacaacaccttaatacgatatccaacaatagcagaatacacattattctgaagtgcacatggaatattcttcaggatgacacatattaggctgtaaaacatatcttaataatttaaaagaattgaaataatacagcacatattctctgactgcaaaatattaaaccaattacagaagaaaatgtgggaaattcacaatgatatggagatttaaaaatacttcaaagtaaccaatgaatcaaagaacaaatcacaagagaaattagaaaatattttagatgaataaaactgaagaaacaacataccaaaattttgtggttgtagctaaagcagtgcttcaagggaaatgtataacagtatatccctaaattttaaaaaaatctcaatccaataacctaatttttcaccttaagaaatgagagtgaaagagcagacttaacccaaagtaaacagaaggaagaaataataaagattagcatggagataagtagtgaaaataaaaacaatagagaaaattaataaacttgaaagttggttcttctgatatatcagtaaaattgacgtattattagtttgaccgagaaagaacaaaagagagaagattcaagttactagacataaatgaaagtatagatatcaccttacagaaattaaaagaattctaacagaatattgtgaaaaagtgaatgtcaaaaaattaaattatatgagatacacaaatccctctaaaggcacaaactaccacagctggtgtaaaaacatgaatacaccatttacagttaaaaagactgaatagataaaaattttaagaagaaattgagtaagtaatttaattttcaaactataatcccaagaccagatgttttcattggtgaattctaccaaactttaaaaggattaatatctatttttcatacactctttccagaaaatagaaaaggagggaacactctataactcactgtatgaggtccgtattacccttatatcaagaccaaacatcataagaaaagaagactaaagacttatggtttctgctctgatatgtttggaagtcatcactactattgtcacaaggaaaaatctgaacaaactaaagtcaacgatttcttaaactaaccatagaattgaggtaacgggcgaaaactggagatgtaggcaaatacaaaaaaaatcacagtttatcaggagcagaaactgctgaaaccagcaactcgtatgaacatgttaagtggtaattgacaaatttctggagattgaatgtggactggattgagagttaggaactcctaagtgcccagtttttgatgaccccacacacttttgtaaactagacttccaagagccccagcaagtttcttacagtgaagactgcagaaaaatcccctgatgcttcagataggaggaagggaaaagcaactattttgaaataagcccaggggacaagtagttatttctaaacactctcagagcattttctttcacacggcagggggctccctgcaagggaagctactttgcctgagccttgtctgatgtaggagaaaaggaattggatggctcaagctccatctagcctttctgatttatataagggaagcaaaaaataggttaagaaactcttctgaaagtcacaactcagatttattttatatttatttatttatttatattttttgagacggagtctcgctctgttgcccaggctggagtgcagtggcgcgatctcggctcactgcaagctccacctcccgggttcacgccattcttctgcctcagcctcctgagtagctgggactacaggcgcccagctaattttttgtatttttagtagagacggggtttcaccacgttagccaggatggtctcgatctcctgacctcgtgatccacctgcctctgcctcccaaagtgctgggattacaggcgtgagccaccgcacctggcctcacaactcagatttaaccataagattatagaacacttctcctcccaaaacagagatatagatcaatggaacagaacagagccctcagaaataacgccgcatatctacaactatctgatctttgacaaacccgagaaaaacaagcaatggggaaaggattccctatttaataaatggtgctgggaaaactggctagccatatgtaaaaagctgaaactggatcccttccttacaccttacacaaaaattaattcaagatggattaaagacttaaacgttaggcctaaaaccataaaaaccctagaagaaaacctaggcattaccattcaggacataggcatgggcaaggacttcatgtctaaaacaccaaaagcaatggcaacaaaagacaaaattgacaaacgggatctcattaaactaaagagcttctgcacagcaaaagaaactaccatcagagtgaacaggcaacctacaaaattttcacaacctactcatctgacaaagggctaatatccagaatctacaatgaactcagacaaatttacaagaaaaaaacaaacaacctcatcaaaaagtgggcaaaggatataagcagacacttctcaaaagaagacatttatgcagccaacagacacatgaaaaaatgctcatcatcactggccgtcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattgctatatatatatatatatacccaaaggactataaatcatgctgctataaagacatatgcacaggtatgtttattgcagcactattcacaatagcaaagacttggaaccaacccaaatgtccaacaatgatagactggattaagaaaatgtggcacatatacaccatggaatactatgcagccataaaaaagatgagttcatgtcttttgtagggacatggatgaaattggaaatcatcattctcagtaaactatcgcaaggacaaaaaaccaaacactgcatgttctcactcatagatgggaattgaacaatgagaacacatggacacaggaaggggaacatcacactctggggactgttgtggggtcgggggaggggggagggatagcattaggagatatacctaatggtaaatgacgagttaatgggtgtagcacaccagcatggcacatgtatacatatgtaacaaacctgcacattgtgcacatgtaccctaaaacttaaagtataataataataaaaaaaggctacctaaaaaaaaaaaaaagaacacttctcctcccaacaccatatcaccacatcaaccaggactccagtgtaatagcagtgaattctaactgaaagaggtgaaagacactgattgtatttaagaaagatcttctaaggaaatccaaaaatagtaggggagatcaaaacaaagatactagaggaaattgaatatgtgacacctatagctacaaaaaaattaaacataacatagccctaaccatataaacataaaacctcacacaaagacctattatctgagattctgttgcctgatacattgcgttttatttcaataaaaaaattagagggtatgttaaaaagcaggaaaagttagtctaaagagacaaattgagcctcagaagtaggctcagatatggcagagatttggcaattatacctagagtttaatataaatgattaatataataagtgttctaacagaaaaaggcaacatgcaagaacggatgggtaatgtgatcagcaagaaggaaactctaagaaagaagtcaaaaggaaatgctaggaataaaaacctacaagaaataaagaatgcctgtgatgggttcctcagtagactggacaaggtcaaagaatcagtggatttgaaaatatgtcaacaaaaactgccccactgaaatacaaaagaaaaatagaattttaaaaacgtaacacaatctccaaaacagtgggacaattacaaaagatgtaatgtgcctaatgcaaatgacagtaggagtataaagggagaaaggaatagaaaatctgaagtaataatggcagagagttttccaaaattaatgctaaaccacagatacagcaagcccagagaacaacaaggaggaaatttagtaaagcgtctgcaaccaagtatgtcatattcagactgacaaaaccaaaggtgaagagaaaatattgaaagaagacaaagaggaaaataaatatcaagaaaatacatacgaaatacatcatacatacataagaaatacatcagaccatacaagcaagaagagaatggagtgaaatgtttaaaatgttgaaaaaaaaactatcaatttgcaattctgtatccagtgagattatctttcaaaagtgaagagggaaatggcagagaagtcatctccaagacctatggtttcccttcacagaaacactgaaaaatatgaacaaaagtggtcagaattaactttctaagaattctataaaatggtaaaatgtttacaccagtaaagcaaatgctgaattgagaaggcaacttaaaaaggtgaagaaaacttcgtattatttttatgtgtccttgccccacgtccttccctaccttagtcttgaagatggcagcccacatttctactgtggggctctggtttctgtttcctggttcaagagggagaataacagaccttacttttagtcattattatttccttctttctgatttccttgggtttattttgctcttctttctactttattgaaatgagaactaagattatgatttgagacatttttctaatgtaagcatttagtgctataaatttccatctcaacactgctttagtcacatcccacaaatttttatatgttgtaatttcactttcatttagttctatttttaaattttttctttttatacttcctctgactcacagattacttagaattgtgttgttcagttttcaaggatattgtagattttcctgtttctctgttgtctaatagttctgttccattttgtacagatagctcacgctgtatgatttcaattttttaaaaaattgtgctttgttttatggcccagatatggtctgtgctgtgaatattccatgttattataaagtatgcctgttatattattatatatatataatatatataattataaagcatgcccgttttgtattgttagcagagtattctagaaatgtcaatgagatcttgttggttgatggtgcttttcagttctatatctttgctaattttttttttttttgcttagtagctatatgagattctgagagaggaaattgaagtctccaaccataattgtggatttgtctatttctcctatcagttctatcagtttgtgcatcacatatttgaggctctgttgtttggtgcatacacaagtggaatcattgtgccctcttggtggcttattttatgattatatagtgcctatctttgtggtatttttatttgctcttaaatctactttgtgttatattcatatacccattcttttttaaaaaaaattgtttgcgtgatacatcttttccattcttttaatctcagcctatctgtgccattgaatttgaagtgagttttcatatagagaacatattattgaatcatcattttaaaaattccttttgccaatcttttttatactgaggtaaaattgacataaaatttatcattttaaagtgtacaatacagtggcatttggtaatacacatgttatgcaacgttaactctacctggctcctaaatgttttcatcatccccaaaaggaaacttcatactcattaagcagttaattcccattccttctctcggccactggcatccgcaaacctacttttctgtctctatgaatttacctattatggatattttgtataaattgaattatacaataagtgacctttatgtttggcttcgttcgcttcgcatactatttttcgatattcaaccatgttgtagtatgtatcagttttatttgaataactcaattctttttgttgtatagctaaaagttgattcctaggtcataatgataattctatgtttagtttattgaatagctgccaaagtttttccacagtggctctgtcattttaaaatcccactagcaatggatgagagttccaatatctccacatccttaccaatattgttattttatatttttataattataattttcctagtgaatacgcaatggtatctcattgtgtttttggtttgcctttccctaatgactaatgatgttgagcatcttacaatgtacttgttaactatttgtgttctttagagaaatgtctattcaagtgccttgtccattttaaaaatcgagttgtcttgttgacttatgagttctttaatacagtaaacgcttatcagatatgatttataagtattttaacccattctgaaggtcaccttttcacttttgtggtagaccattatgcacaaaggttttaattttgataaatccaatttatccgcttttgttgttgtttttgttgttcgtgcttttgcaaaacctagtgtcatgaggttttctcattatctttggagaattttatagtttgggtctatacatgtagattattgatctaatttccattaatttgtgtgtatgctacgaggtaggggtccaaattcaatttttgcattgaattgaaaattcatattttcagtttcaaatttcaactgcatattcagttgttgcagcacaatttgttgaagagatcattctttaccacagggaatgatctgggacccttgtcaaaaatcaattgatcatagatgtatgggattatttcagactttagatcttgttccatgaatatgcctatttttatgccagcactgcagtattttcattactgtagctttatcataaattttgaaatcaggaagtatgtatcctccaagtgtgattttcatttgctagagtgttttgactatttggggtctttgcaattccatatgaatttcagaattggcttttcatttaaaaaaatggtagttgagattttcataggaattatattgaatctacagatcactttgggtagtattgccatcttaacaatattgtattccaatccataaacacggatgtattgccattcatatctttttttcttttctttcggcaacatttagtatatgacacttgtaactccttggttaaatttatacctaagcattttatcctttctgatgctgtttaaatggaattattttattaatttctcttttagatggcttgttgcaggtgtatagaaatagaactgattattgtgcttttattgaattatctgaaactttgctgcatttattaactctagtaggttttttttttctttaaagttgtctatatatcttgctctgtgaatagataattttacttcttgatctccaatatggatgcctttctttctttttcttacctaattgctgtagctagaattttcagtataatgtatgatagaagttgttcacaactatccttgtcttctttctgatcctaggggtatagctttcagtctttcaccattaagcacaatgttagctgtggggttttcttagatgccatttaatatattaaggaagtgctctgctatttctaattggttgagtatttttattataaaatggtgttagattttatgactttatgtactgcataattgagattatcatgtggtcttttcattcgattaatgtggtatattttatgattttcatatgttgatccacctttatattcttggggcaaatcccactgtgtacacgggttttttagggtctcctaattttcttcattctttttcttttctctccctgagactgaataacgttaactgacctatcttcaagtttactattttttcttctgctgttcaaatctgcttgaacctatagagtgaatttttcattttacttattgaacttttcagctccaaaatttctctttggctactttgtataatatctatctctctatagatattctctatttggaaagacatttttctcctggttttctttacttatttgtattttttaaagtctttaagcatatttgagacagttgatttaagtatttgtgtactaagtccattgcctaagcttttgcatagagattttatattaatttcttttttttctgtgaacaggtcttttttttttttttttttttttttttttttttagaaaactggacattttgagtagtataaacgtggctattttagaaataattttcctccctccttaggttttgtttccacttgttgcatgttgctgttgtttgctcattagtgacttttctaaagtattttgaaaagtctgtgttcttgatcatgtgggtccattgaattctgtattctgttaatttcatagtcagctagtgttctgaaagttcccttaagtgcatagagccaataaaagaaaaagaaaagaaacacagaaaaagaaaagaggaaaaaaggagggaaagagatttaaaaaaataatgtcggttgggcatggtggctcatgcctgtaatcccagcacttttgggaggccgaggcaggcaaatcacttaaggttgaccatcctggccaacacggagaaaccttgtctctactgaaaatataaaattagccgggcatggtggcacatgcctgtaatcccagctactcgggaggctgagaggtaggagaatcacttgaactcgggaggtggaggttgcagtgaactgagatcacaccactgcactccagcctgggcaacaagaatgaaactccatctcaaaaaaaaataataataataatgcctttgccgatttgctctgtgtttgggccctcattcaatgcctagtcaggccatttacaactctctcttaactttcactacctgcttgtgtactgactgaaggccacctataggtgaaagcttaacatcatctcagatctttttggaccatgaatcctaccctgggtatgcacatgatcttcttaatttcccagtagatgcaagagttttagtgttttaaaagtccttattccctcatctatcttcttttctgacctttttcagtctgcttattgttcatctgaactgacatcctttgccccaagcggctgtggcaaaaacttttacctttaaatgctttcaccacaagccacttgggaagctgccccagacctgggactgctctgaccctgatgaaacaaagacaagaccttgtacagccaggcagccataagacaagtccatacccaaaccacagttctttcagaataaggtctatattggattctctggccctagtaaccagcatgagtctgggcttgccatcttcatggccacttgtcttagtttgctagggctgccataacaaaatatgagagactgagtggcttaaacaagagaaatttattttttcacaattctgaagaccagaagtccattactctgaaatctctctccttggcttgcagatactgccttcttgccgtgtcctcacacagccttttctctgtgtacacatccctggtgttttttaagcctgtccaaattttctgttcttctgaggacaccaatcagattggattagcgaccacccatatgatcattttaccttaagtacctcttcaaaggtatcagagtagtatatttgctacagttgatgaacctgcatacaacatcatcacttgaggtctgcagtttacattagagttcatcgttagtgttatatattctagggtttgttttgttttgagacagaacagagtcttgctgtgttacccaggctggagcgcagtggtacaatctcattgctacctctgcttcccagattcaagcaattctcatacctcagcctcctaagtagctggaactacaggcgcacaccaccatgcccagctaattttcgtatttttagtggagatggggtttcaccatgttggccaggcaggtcttgaactccttgcctcaagtgatctgcccgcctcagcctcccccagtgttgggataacaggcatgagtcaccatgcctggccttattctatgggttttgaaatgtataatgacatgtatccatcgttgtagtattagatagaatagcttcattaccctaaaagtcttctttgcactgggttgagttttaaaagctctttgattattttatgacagttccttattagatatatcttttgcaagtatttttatcagtctgtggttatcttgtcttttacagagcagtaatttttaattttaataaaatccaatttgtcaattacttatctcatatgactctggtgttacatctaaaatgttaccaccatactcaaggtcacctaggttttctctaggaattttatggttttgcattttacatttggtgtatgacccatttgaagttaatttttgtgaggttgtaaggtctgtgcctagattcattttttttttttttggcatgttacttcagtattcataagaaacattgttctgtaatcttctttcttatagtatcttagtcttgctttagtttttgggcaatgctggcctcactgaataaattcaaagtgttccctcctcttcaattatttggaaaagtttgagaaagactattgttaactgttttctaaatttttggtggaatttaccagtgaaccaactggtcctaggcttttctccagtaggtggttttgattatgctttcaatctctttacaagttacacatctatacagacttttataattcagtcttggtaggttgtgcgtatttaggaatctgaccacttcatctaagttatccaattagttggcatgcaattattcgtagttctctgaataatcatttttatttccacaaaattggtaatatcccagtttccattttttatttcattgaatcttcttttttcttagctaatctagctaaatgtttgccaattttgttgatcttttggaagaaccaacttttgatttattaattttctctactctttttctgttctttatattatttatttccacactaatctttactattttcttccttctgttggcctttaattttttttttttaatttttaaggtgtaaatttaggttgagaaattttttaaatgaaagcatttagagctataaattttccttctggtgttcctttcactacctgccataaattttgatatgttgagtttttgtttgtcttggagtattttctaatttgtcttctaatttcttccttgacctattggttatttaaatgtatttaatttttgcatattgtggatttcccagttttccttctgttattgatttctagttttattccattgtgatcacagaagatattttgtataatcgcagtctattaacatttattaagtcttgtggcctaacagaggatctatgttggagaatgttccaagtgcaattgagaatactattctggtgctattaggtgaagtattctctatatgtctgttaagtccaattcatctatagtgttgacgtttcctgttccttactgattttctgacttattattctatccattattaaaagtggagtggtaaagtctctattattgtagaactctctgtttttcaagtctatcaatatctgtttcatatattttggagctctgtttgctgcatatgtgtttacaattgttatatcttcttggcaaattgaccagtttcatcaacataaaatataattcttattgtcttctaacagtttatttttctttttacataaagcctattttatctgatcttagattccctcacactccaccccagcacgcttttggttacatttacataatatatcttttccatcctttcattttcaacctgtttgtgtctttagatctaaagtgaatgtcttacagacagcataagctatgtcattaaaaaaatccattctgcttatctctgccttttgactggggagtttaatccatttgcatttaaagtaatcactgatcattaaatactttcagtattttgttgttttatgtatgtcttataactcttttgctcttcatttccttcaatattgcctttgtgtttagcttatctttttgtgtcacactttgatccccttctcatttcttttttatattttctttgtggttaccaggaggacaatgtatcaacttttaaagttattacaattttatttttttaaatctctcccattcggggattttaggaaggttaaataataatgtaaatgagatacctagaacaatataagcattcaggaattattaactcaattccaatccttcctccacctccacctctttctctgtgagattatagaaaagatgacaaaaaggatgttttctgagccctttaattgttgagaatgatctttgagaaaaagaaaaaaaatgaaagcactaggaatgtacaacagcctggaagtataattaagtgtaaattaaatagataaaagttataagcagaggaaagtatagtagaactcagtatttaaaagagaatcaatgtgaaaattatataaatttatgtaaaataaaactaccagacaaatctgatatccttaggatttttctttctttcatgtgatttctaattgctacatatgacactaaaccattgatctgagctgtaagagaaactggaaattgttctgttatcttttgtaagatttctagaacattttgccctcagacttaaatgccaacgtatttctcacttattgtttactgcttttggatttacatatgatttgattctttcttatctcttatccttacaatgtaattcaaactgatgccaatttaagttcaattgcgtacaaaaactctactcctatgcagctccgccccatctaatttacattattgatgtcgcaaattccatctttgtacatagtttacatattaacatggatttatacatttttatgtatttggtttttaaatcctgtagaaaataaaaagtcaacacaccaatattaaaataatactggtttttatatttgtccatgtgcttacctttatcagtgttctttacatctttatacgggtttgagttactgtcttgtgtcctttagttccaacctaaagaactccctttagcatttttatagggcaggtctagtggtaatgaactctctgagtttttatttagggatgtcttaatttctagctcctgtttgaagtaaatttttctggatatacaattctctgttgattgatttttgttcattttcccttcagctcttttaaatacattatcccactttcttctgccttccaaggtttctattaacaaaattcagcttataatcttattaaagatctcatgtacatgagtggcttctctcttgctgttttcaagattctgtgactttggtttctgatagtttaaatataatgtgtcttattgtgggtctctttggatttatcctagagtttcttggtcttcttacgttggtatatccatgtatttcaagacatttgagtagttttcagccattatttcttcaaacaatctctcctctttggggacttccattttacctatattggttcttttgatggtgtggcaccagtcccctagactttgttcacttttttccagtcttttatttctgcttctcagactcaacagcttcaagtgttctgtattcaagtctgctgactctttcttcttccagctcaaatctgctgttggatccccccttgtaaaatttttaattccattttagtgtttttcaagttaagtatttttattaggttcctttttataatttctttttgttgatattctcattttattacacataatttgtctgatttccattagtttttttctttgttttcctttagctctttgaaaatatttaagacattttaaaagtctttatccaagttcaatttctatggttctgtagagatattttctgccagtttatgttcttcttttccatgggccatgttttcctgtttctttgtatactttctaatttttggttgaaaactgagcatttgaaaatagagccaactttcccagtttctgcagagagtctttatgccacagtattcgttcactgattaactgggtatatctaagcttagggagcagctgagtcaaaagtttaaggtcttctcaggtcttttctgagtatacatgtttcctatgcctgtgtgaaatgttctcaatttccctatataaacagctacttcttcttttttttttttttttgagatggagtctcgctctgtcacccaggctggagtgcagtcatctcagctcactgcatcctccacctcccaggttcaaacaattctcctatacaggtgtgtgccaccacgtctggccaatttttgtatttttagtagagacagggtttcgccgtgttggccaggctggtctcaatctcctgacctcaggaggattacaggcttgagccacagtgtccagcctaaacagctacttttgaatgctttaatttcctgaatagtctcaacccagtttttccttgaggtcttaggtggtccattgtatgtctccacccatagttgcttgccccaggcatctgtgggtctgtggtaccactgcagctttcaccacctgtagctgccacctttccctatctgagatccaggttaggtgagagagatcattccttcacgcagtcccatgacaggttggaacatttcaaataaggtctgttctgctcctctggttgaagggagaaaattgggaaccggtttcccaccttctacaaaccaagatctcatgttgccacgggagtggcagggcaagtgcaagtgaaaatgccatacaattttctaccattttgaacgcgggtttttcttcaatggtcatttgcttggttgctgtaggcctttcactgttttccagagctcccataagattactttagccagttttttgttctttcctgatgcttccctggcagagtaagggttggaacttccaccattttgctgattcataactctgtagtcagttttaaatatattgatacttgagtttgttttatggcccagaatatggtcttggtaaatgtttcacatatactcagaaagaatgtgtattctgatgttgttacatgggctgttctataaatgttacttaaggtggttaataatgttgctcaagtcttctatattcttgctgattttcttttatttatttattttattttttttattatacttttaagttctagggtacatgtgcacaacatgcaggtttgttatatatgtatacatgtgccatgttggtgtgctgcatccattaactcatcatttacattaggtatatctcctaatgctgtccctccctgctccccccaccccatgacaggccccagtgtgtgatgttcccctttcctgtgtccaagcgttctcattgttcaattcccacctatgagtgagaacttgcggtgtttgtttttttgtccttgtgatagtttgctgagaatgatggtttccagcttcatccatgtccctacaaaggacgtgaactcatccttttttatgactgcatagtattccatggtgtatatgtgctacattttcttaatccagtctatcattgatggacatttgggttggttccaagtctttgctattgtgaacagtgctgcaatgaacatacgtgtgcatgtgtctttatagcagcatgatttataatcctttgagtatatactcagtaatgggatgggtgggtcaaatggtatttctagttctagatcttgaggaatcaccacactgtcttccacaatggttgaactagtttacagtcccaccaacagtgtaaaagtgttcctatttcttcacatcctctccagcacctgttgtttcctgactttttaatgatcgccattctaactggtgtgagatgggatctcattgtggttttgatctgcatttttctgatggccagtgatgatgagcattttttcatgtgtctttggctgcataaatgtcttcttttgagaagtgtctgttcatatcctttgcccactttttgatggggttgttttgttcttgtatatttgtttgagttctttgtagattctggatattagccctttgtcagatgaggagattgcaaaaattttctcccattctgtaggttggctgttcactctgatggtagtttcttttgctgtgcagaagctctttagtttaatgagaccccatttgtcaattttggcttttgttgccattgcttttggtgttttagacatgaagtcctcgcccatgcctatgtcctgaatggtattgcctaggttttcttctagggttttttatggttttaggtctaacatttaagtctttaatccatcttgaattaatttttgtataaggtgtaaggaagggatccagtttcagctttttacatatggctagccagttttcccagcaccatttattaaatagggaatcctttccccatttcttgtttttgtcaggtttgtcaaagatcagatggttgtagatgtgtggtattatttctgagggctctgttctgttccattggtttatatctgttttggtaccagtaccatgctgttttggttactgtagcctcgtagtatagtttgaagtcaggtagtatgatgcctccagatttgtccttttggcttaggattgtcttggcaatacaggctcttttttggttccatatgaattttaaagtagttttttccaattctgtgaaggaagtcattggtaacttaatggggatggcattgaatctataaattaccttgggcagtatggccattttcacgatactgattcttcctatccatgagcacggaatgttcttccatttgtttgtgtcctcttctatttcgttgagcagtggtttgtatttctgcttgaagaggtccttcacgtcccttgtaagttggattcctaggtattttgttctctttgacgcaactgtgaatgggagttcactcatgatttggctctctgttagtctgttactggtgtataagaatgcttgtgatttttgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctttctcctgcctgattgccctggccagaacttccaacactatgttgaataggagcggtgagagagggcattcctgtcttgtgccagttttcaaagggaatgcttccagtttttgcccattcagtatgacattggctgtgggtttgtcataaatagctcttattattttgagatatgtcccatcaatacctaatttattgagagtttttagcatgaagggctgctgaattttgtcgaaggccttttctgcatctattgagataaacatatggtttttgtctttggttctgtttatatgatggattatgtttattgatttgtgtatgttgaaccagccttgcaacccagggatgaagcccacttgatcatggtggataagctttttgatgtgctgctggattcagtttgccagtattttactgaggatttttgcatcaatgttcatcagggaaattggtctaaaattctctttttttgttgtgtctctgccaggctttggtatcaggatgatgctggcctcataaaatgagttagggaggattctctctttttcctatttactgtacatttattccaccagtgactaaaacaggtgtatcaataaaatctgttccctcaggttttgcttcaggtattttgagggtctgttatcaggtgcataaacaagattgttatgtcctattcttaaattaatctccttataattatgaagttaattttttttttcttgagatgcagttttgctctgtcgcccaggctggagtgcagtggcacaatctcggctcagtgcaacctctgcctcctgggttcaagcatttctttgcctcagcctcccgagtagctggggttacaggtacctgccaccacgcccggctaatttttttgtatttttagtagagatggggtttcaccatcttggccaagctggtcttgaactcctgaactcttgatccacccaccttggcctcccaaggtgctgggattacaggtgtgagccactgcgcctggacctggcccgaagtaaacttctttacccttgctaatgatctttgctctgaagcatgctttgctggtattaatatagtcattccttctttctttgattcatgtttgcagggtatatctgtttccattcttttacttttaacctattgtctttatatttaaagtgcatttcttgtaagtataattggtttcttaaaatccaattatctgccttttaaatgtcatttttatatgatttgcataaatatgattattattacagctaaattgaaatctgtcatcttgctatttggtttctatttatcccatttttttcccctctttttttgctttccttgagattgaacattgtattagttttctagggttgctgtaagaaagtgacataaagtggatggcttaaaacaacagaaatttattgtttcagtttggaggctagtcatctgaaaccaaggtgtcatcagggccgtattctctctgaaacctgtagggaagaattctttcctgcctgttctagcttctagcattttccagcaattcttggcattcctttgcttgtagatgtatccctccaatctctgcctctatcataacatagccatcttctccctttatctgtctattcttctcatcttataagaacattaattactgaattggggcccagcatagattaggcctaatctcatcttgaataggttacatctgccaaagattcttcttccaaataagatcacttttacagcttttacaggtactgagagttagaacctcaatatatcctttggtggggaccgacctcttacccataaaaagtattttatatgattccattttatctcctttttaggttattaactacaatttttttttcttttttttgagatggagttttgctcttgtagcccaggctggagcgcgattttggctcactgaaacctctgcctcccgggttcaagtgattgtcctgcctcagcctcctgagtagctgggattacaggcatgtgccaccgtgcctggccaatttttgtatttttagtagaaacagggtttcaccatgttggctagggtgggtctcaaattcctgaccttaggtgatccacccacctcggcctcccaaagtgctgggattacaggcgagagccaccacgcctggctttataatttttttttaattcagtggatgttttagggtttatagtatacatctttatcacagtctagctccaagtgatatatccctttatgtatagtacatgacccttacagtagtgcatttccatttttcctctctggcatttaggctattgcacacacatacactcaattcatccctttgtgtagatccgtatttccagctgctatcttttgcttctgtctgaaatatatgtatgatttcttttatgactattttgagaaatttggttatgtgcatttgtctatttttcttatgtacttttagctcatcaatcttaagtctgtgagtttatagtttttaaaaacaaatttgaaattatttggctattatttcctcaaatatttttttctgccgcccctgctttccctttccttagggatctctgatttccacctatattactctgattgaagttgttccacgtctcttttgaaaatctctgaaaaatcttttatcatttggataatctgtatttgtacatcttcaagtacattaatattttcttttgcaatgtttaatctgctgttaatcccatgtagtggattcttcatctcaggtattgctgttttaatctctagaaattccattgaagtcttacttgatgaaaaaggcagataaaaacaaatgttggcaaagatatggagaaatcagaatctgcacacactgatgatgggaatgtaaaatggtcaaggcaatttggaaagcagtctggcagtttctcaaaaggctaaacgtagttcccatatgacagcaatcattcatctaggtatatactccagagaaataaaaacatatccacaccagaacttgaacattaattttcatagcaacattattcctaggggtttaaaattttttacattatttttatttaaaatagagacagggtctcactacgttgcataggctggtctggaactcctggaattaagcattcctcctgcctttgtcctgttttctccactggaaaagaataaaactttgtacacttggactaacaactcccgattccctcctttaccaacatgccccacagcctctagtaacttactctctactttcatgaattcaacttttttaagattccacatataagtgagatcatacaatatttgtctttctgtgcctggcttatttctcttagcataatgtcctccagattcatacatgttgtcttaaatgacaggatttaccttcctttaaaggctgactagtacttcattgtgtatatgtatcacattttctttatccacttatctgttgatgggcacttaaattgtttcaatgtcttggctactgtaagtaatgcttcaataaacatgggaatgaagatatcccttcaacatattgatttctgttcttttggataatactcagaagtgagattactggatcatatggttgttctatttttttcagaaacctccatactgtttttcatagcggctgtactaatttacattcccactaacaatgcatgagttcacttttctggacatcctccccaacacttgttatctttcatctttttcataaaagccattatataataggtgtgaagtgacatctcactgtggttttgatttgcattactctaataattagtgtgagcattttttttttttcatgtaccgaatgtcttttgagaaaggtctcttcattcctttgcccattttaaaatcaggtggttttcttgctcttgagttgtttgagttccttatgtattttagatatttacccatttccagatatatcatttatattttttcctattctttgagttccctcttcactgtgttgtttccattgctgtgcaggtcttttattttgatgccaccccatttgtctatttttgccatgcttttgcagtcatatccaaaaaaatcattcccaagaccaatgctgtggagatttccccctatgttttcttcagtaggtgtacagttttaggtcttatatgttaagttttaaatctatttttttatatggtgtaaataagggtctaatttaattcttttgcatgtggatatccagttttcccaacaccatttattgaagaccctgtccttttatacttttcagtatgcagatcttttacctccttaaatttacacctcagtatttaatatttgttgctattatgagattttcataatttccttttcagatagctcattaatagtagatggaaacactactgatttctgtaagatgattttgtattacggaactttactgagtttgtgtatcagttctaccaggttttagttttgttctggtggagacattacagttttttgtatatggttatgtcatcagtaattacagatgatttaacctattcctttcctattaggatgccttttttttctttctcttgtccaactgctctggttaggacttctagtactatgtcaaaaagtgatgagggtcgtacatggcctccatacctaatctgttgagagtttttaccatgaaaccaggttgaattttgtcaaatgctttttctgcatccattgagatgatcatatgatttgatttacaccctccattttgttatgtggtatatcacactttttgatgtgcatatgttgaaccacccttgcatcctaaggataaatcccacttcatcatggtgaatcattctttgtattcgtgaatccagtttgctaatatattgttgaggatttttgcatccatgttcatcagggatattactttgtaagtttctgtccttaaagtgtctttctctggctttaataacagtgtaacactacccttgtaaaatgaatttagaagtattccctctgcttcattgttttggaaaagtttgagaatttttattagttctttaaatgtctggtaaaattcagtagtgaagctgcctaatcctgggctttcctttggtgggatactttttattactggctcaatctcttttcttgttattggcttattcagatttgtttcttcatgattcactctttgtaggttgtatatgtctaggaatttattcatttctttaggtcatccaatttgatggtgcataacttcatagtagtttcttataatcctttgtattttggtgatatcagtagtaaatgtctcctctttcatttctgatcttatttgagtactctttttttctcctagtctaggtaagaatttgttgattttatctttcaaaaaaaaaaaaaaccaactcttagcaactcttagttttgttcatttttttccagtctttatttcaactgtgatctttgttacttacttctttatgctaactttcgggcttagtctgttcttttcctagttcctttaggtgaaaagtgagattgtgatccttcttctttattggcgtaggtttgtatcgctataaatttccattaggactgattttgctgcatcacataagttttgtttccattttcatttgtctcaaggtaattttttatttactttttgacttcttctgtgaactattagttgtttgggagcatattgtttaatttccacatattgctgtattttccaccagaattgattcttgttcttgatttctagtttcacgccattgtaatcagaaaagggatttgatatgatttctgtccacttaaacttaagattagttttgtggactaacatatatcctggagaatgttccatgggcatttgagaacaaaatgtattttgctgcttctggatggaatgtttcatatatgcctgttaagtccgtttggtctaaagtgtaattgaaatccattgtttctttattgattttctgtctaggtgatcaatctgcccatggtgaaaagtagagtattgaggtcccgtattatagtattgcagcctatctccctcttcacatcatttaaaaattgctttatgtatttaggtgggtcaatgttgggtgcatatacttttacaattgttatgtcttcttggtgaattaatccctttatcattatataacaaacttctttctttttatagtattgacttaaagtctattttgtctgatagaagtatagctacccctgctctcaatttccatttatatagaatatctttttccatcccttcactttcagtctatgtgtatgtttagtagaaaagtgaatctcttgccgggcgcagtggctcactcctgtaatcccagcactttgggaggccaaggcggcgggatcaccagaggttgggagttagagaccagcctgaccaacatggagaaaacctgtctctattaaaaatacaaaattagccaggcgtggttgtgggcccttgtaatcccagctactcgagaggctgaggcaggagaattgcttaaacccgggaggtggaggttgcggtgagctgagatcatgccattgcactccagccttgacaatagcaaaactccgtctcaaaaaaagaaaaagaaaaagaaaaaaaagtgagtctcttataggcagtatgtggttgtgacttaaaaaaaaaaaaaaatccattctgtcattctatgtctttttgttggagaatctaatccgtttacattcaaggtaactattggtaagaaactgctagtgtcattttgtaatttgttttctgattgttttgtaggtcccttgtttcttttttccctattgctaccttcctttgtggtttggtggttttctgtggtggtgtgctttgaatcctttcttttatagtatatgcgattaccattgtatttgctgtaaggctaacttaaaacattttatccttaggctactttaagcgataaaaacttgcctttagttgcatacaaaaactctacgctttcacaacccccccgcctttcgtgattttgatgtcaaagtttacacttttttaaatttgtatctcttattgtagctacagttacaattacttcttgtagctacaacttattgtagctacagttgtttttaatagtttcatcttttaaacctcctaataggaataacattgctttacctgccacctttacaatactagagaattctgactatgaattacttataccatttagttttttacttttatgtttctcattaactagcagtcttttatttaagcctaaagaactcccttttagtaattccagtagagcaggcctagtagtgacaaactcccttaggcattgtttatctggaaaagtgtttatttctccctttgccaagtaaagtattcttaattaacagctttgtttccttcagcactttgaatataccatcccactctctactggcctgtaaggcttttgctgataaagccactgaatctgtattggggctaccttgaatgtgatgtttcttatctttgctgctttcagtattctttgtctttgatttttgataacttggttgtgatgtgtcttggtgaactctttaggttgaatctgatcggtgacctcagcttcctgttcctgaattttgtcatcttttctcagatttgggaatttttcagctattacttccttaaatatgctttctaggcctttttctttcttttctccttaaggacctcctattatgcaaaagttagctagcttgatgtgtcctgtaattcttataggcattcttttttgtttttgtttctcattggataatttcaaatgtcttacctttgagctcattgattcttctgcttgatcaagtctgctgttgaagcgttctacttagattttcagttcagttactgtattctttatctttagaatttctattgtttttgtttatatttgttaaacttctcattctgttcagatgttgttttccaaatttcatttttctatccatattttcttgtactttgttgaacttaagaggattagtctaaattatttgtcatttcacaggtctccatttcttctgagtctgttactggagctttcatatccaatgtacaccagaaactttgctaattccacagtaaatgttagaaatgggtttttattgataaaatcagtggcttgctaattagtatgttagaagctggcttgcattggtgaagttgagggtattcgatatacgtatcccggctaaaatacttctaaagaacctctccagctttgcaagaatagagtataggaatctgaggaggcctttaacatggccctcagaaaggacacacagggcttgacctctaaacatataaacatatacagaaacgaggtcagaacatgttttgactgatgccagtagtaacacagcagagcctattgctggtcactgttaccaataccttgtgtaataaacctttcatttaaattgagaggttgtaagccccgaaaaagcaaagggcttacagtacctcttgcctgaacactcctgtgtgtgctttctaagaaatgcttttaaaataatgcctgtggcacaaattgatttgacactggctctctttataagctgctatcaaggttgtggggaatagctaactcttacccactttccctgacaaataggaacccgtagttacctaccaaaagtatgtaaaagctatatccgacccaaaggccagttaggtcaaaacaccttgaaaggagctcagtttaaggaaatcagtggtgtcacagtgccccactagcgtgtaaaagttttcatagtttgactatcggatgtgcttagtttcacagctgagtcttaccttgtgatacttttagagcaaaagtcaaatcaaagatgatttaaaaaaacatttcaaagattcataaagaataaatgcctcctcaggaagtcttctggagttctgcccacttcccttaggtggctctttactgtgcccatctcatagcctgtctccttccacttggtgtattgcagagtaaagctcactgtttacaggggtggtagaaagtgtggtcctttcccagactcctttttcccttcctcttctcatttttcagaagatgtgtttgataataaacgaaacaaaatgactaacacattgagctgagctacataagcagatgtcagtttgacgtgaagagtttaaaagatctatgcattatctggggactcctcccccagacctgaaggatcaggtgctgccttctatgccacctgtgcagacagcaaaagaggaaaaccatacccacgttcagtatgaacaaaggggacatttgaactctgtgtggacccctcattggaagggtgtttcttctcctgctgcatccacaaagagcactccttagccttgccttttgtcagttctctctccaataaggcttgagcagagacaacccagtgcagttcagagagactgaagtctggtgttccaggtctgagtcctagctctagctctctgtgtaactttgggatgtcccaaagtaacttttcacaacttgataggtgttaacttgaattttggatacaggtgactcttagcccatcccctctctgtgcttcagatatgtcatcacttgggccatatgacctctggacacctttcctactttccacaatttcagagcagcagagcagactggagctcctgctgcctctgagcttcagtgaattatcactcgttggagggaagcttcaagcattttgttatctttcaagagcaaacacagtgtctgtcagcaagaatatgtagcagatgctagtgaacagcagtgattagggttgaatgctggatttaaatatggagcttaggctgtgaaggaagcctgaagaacctagagccccatgaagctgccctctgtgagatctgacaccatttcccactgatgagccatgggtctaatgggtagcactgattccacatacagtatgtgagtgcaatacagtgaaagcaaagagaataaaatgatggctaacatgatgttccaaactttaaacaggagaaaaacacacaattccattatgtataagaacccacacagagatcaggagaataacctcattggagaatgaatgacctgtgtggggaatttagggtagagttgagattgaaaaaatgggccgaagtcaggtggccaagggccttaataccttgtatacaagatgtgtagtcaaggaagaccatgccttacttatgcatcaattcccttgggcctacaaagagctgcctagcctgggactgttgtagagaaaagctacagtgttccaatgacacagggactcctccatgtatgtatgagtgcccagctggctctgtaataaatcttatttttatttattaacttttcttgcgcattggcttgatgcatcagttggaagtcagaggccaaacgaagtgaacactgagccaaaggaagttctcagcctttagggaggcagaattcactttaaacacaataaacaaatgaactcacattatacaggagagagtcagaagatcccagtggctggtgtcatcgggccatatttgcccgaagtgcctattccttataggaacccactcccagggttgatgggctacatccttaggaggctttatgcctatgttctcctgaccactggctcctccagggctggccttttttagtctctctgtagaggttcctgtagctggttggatataggctttcacagaagggtcagtgccttgggtctggttacaggactgttaatcttgctttgttaagagtaatgttatttccccatttccaaattctccagggagatggaatgtcaaagatagtatgactgtagcacctaaatcctgggttccagaagcagagaagagaatacactgaagctgtagaaaggcctattagtccatgtcagagattaactggatgcgaggaccatttctgggatggtgtatacagaactggagaactggatagggagtcagaaacaaagagctgaagatgatgcctttgaagtttccaacgtggataactaggtcaacagaatattactcaagaaagtattaacataggattgagatgcagtcagtagtaatggaattgaaatttcaaagtatatacctcatggatctcagggggtgttgagctgatcacctgggctaacactcctatgaccctggggaaaatcaaatgacctggtactgtagccatggtaggggtgtcatcaccttaatccaactgggacagtgctgtttgatattcatctggaacttggtgcagacccacattttgctgggtttcaccacaaccaaggcttttttgattcttttctcttttaacatcagtacatcactgcaaagttaatcctcatataataggagatgaaactaattgcttataaaaacaagatttttacaacactaaaattgttcaagcatatgggcatatttatagttgcaggcagtgtttcagatgcagactgttcttggctgcagtggttgtttacaggcagcatctgttctgattaaatatttgatgattatccccgaatgttttaaagcatagtactgggctctgctgactgtacaacaaactggcatttttgacctatagggcactgggctaggagatacagttctgagggaagtgaaagatagttaacaactgcacaactgaccctttattagttgcaataaagcaatccaaccacccaacccactgtgatggctttcctactatttaaggttggtggtgtcaaagagacaccctcctgtacagtgtgcagtgaatcaacatcatttccacaaaacctccttcctgcacaaaggaattatcatactttgttacgaagtaaaattttcctgtatcagtcacaggagttcaccagttaagatactgttagttgaagacttctggggtgacttaatgaaatagctcagccatctggtttaaaaactggattcttctatccctccacacagctgtccatgcacctgcatcatctcaaggctggtctccctggtggtagaaaggctgacagtaaaaactggagccacatgattccttgcttaggcagtgtttcttcatactctcacatgagagcaggcatgttctttccctaggctcacagtaaacactctgtcaaatctcacaggcccaaagtgcttttggttatccccattccaagccaatctgtggcatggaagatagcattaccctgactgccttagactaatatacctactccacttctggggctgggaataattttgaggtcaaccatccaaactgcatgacagccattccatggaagaggtatggcctaaatctttggggcaacctgaattcatgaaaactctcttagatttatgtaactatttttagaattcacttctgtatcatttaattttactaataaaaataccacctttaccctaaatgtcagccaagcgtaaggctccgttgggacagaaggaactatcaaagctttgtgtttttatacattagcagcatttgacaaagaaataactctgaaggaaggagaataaccaggcagagtctagatgcatggaaaagaagtctttgagaaggcttcgcaggctgaaggaaagggcaggactacttcaggaatacaacgtttaagtaaaagaggttggggtctgttgatcttgaggagagatgaggatggactggaaaataggagtgagatatagtaggagaggaaaggatatggatgatgtatatactgtatgggtaaccatcagtcgaccctaagaagataatagttgttaaatggttagctatttaatgaaagaaacctgaacaagtaataatcttgagttgcaaagtggctggagtcacacaacagactaaatttctggtagaacaaatccagcagcttatgtgaaggttaccatgtctgaagctggatagaaaaggtctaacttccaaccaaagtcacagttcttgagctcggtacacagagacagactgctaacagctgatgtgtcctcagcgagagtgtcctcatttatatcctcgttctcttctgcctcctttttttgttttaaacttttgggaagtctcatcattcaatacagttctaatatatcacaataacagaggcggcccaatttctacaaattgactaattctatccctgaaaagttcatacaataaaactatacaaagcatcattttcaaccatcctatagaaaaatttccctattaaattttaactctaaatcctctatctctgttaataaccttactaaaaacttccccatcactgcctgccagggagatcaaaagaaaccaaatttaagaaacctccaacacctgtacctgactgaaaagcaaacatacagacctttcagtcctgcccctactattcagctcctatcacagagacatggtggatgtccccttgggaagcggatagctcttaggtggaagctaggcctgcaataagcaggccaggaaacatgtctcccaggccccatactcttggcagaagcacttggccaccagacagcatgtcctgtcaacctacagagttcttaaaaacaaacactgggacccagaatagtaccctgtggtcatagtgcccacagttcactaagcaccctcacaggtctttgacagaacactgactgccaggtcacctggtgggcagagaaatggaagattcccaggcccaactagcatctcagggaagaaccacaagcagagcaactttcagagctggtcggccagcgttggcacccagggaagcaagtgctattccatatttggagagaacataaaactcaaggaaacagagaagtcctactcaataccgttctcaactgaaaacaagagaacttgcaaaaaagaaacccagttttctggagtccatggagaaatatgaagccaatgctcggctaacagagcagaaagccttttataaataatgccagtcaaagctccaaaggtcagagctgatgcatgccggattgttctgacaatttcttaggtttctaggcaacaaggagctggtcaaacagctcacctccaaggacatactttataataccaccctggtagacgagagcgaggcagcagtgaaggcaatagtcaagaacaggagagggaggtaaagaacaagatgctcttcagacagtctggacaaagacagtccctacccagctctcaggagttgcctccttaagaaggtggaggcccaggcagctcccagggtgaccctaaagacagactccaaggaaaagggtgtgagggcaatggtgaatataaggaggtcccctttcagtaggcagagcaagtcagttcaggtcttatttttagagtctctgaacagtgaagagaagctttctgtggacagcattccaccaccatgggaggggaaaggtgccatgagagacttctccagtggggcatacaagcattgtgcagtgatccccaagatccagccactggcaggaaatcgaaaggcaagcttcttaaatacatagtatatggagacagaagtgtggagcactcccaaaatgaaaggccaagacccaggaacaacctccacaacctggagtatatacaaatgaacccagccctgctgactcagatccacaccatcctaaagcaggggtttctcatgaatgaaagggctaagtatttggtggagagaatgagaagtctcccactgcccacacattttttcttcagagatttcttttccaagagccccttgaataaaggaagggagggagcactgaatgccccagaaatcagaatgcatggtgcgggaagacgacaggaaatagttctcaaagagatcagaaaataaattggaagcaatttcattaccacaaagaacagacattttttctaaggcacccctcccctttccacccaattgtcattcagcaactactgaatacttaccaatgaaaaacgttacccctgacctcaaggctgctcctgagctctggtagaaaatgctttccttgtctataaaacatggcaagcaaggcaggatttaacagtaagggcacagtagcactgcaagccttcaaatggaaacctggagacaagcagtgagaacaggaagcaaaagcagggcaggtgaagctaggaccagggcatctggaactttccacacaggttggatctccatgccagacaacagttttcaaggaaaaatatctaagaggaacatgactttgggaaactttttggcagtactgcttactgtatactagagagtaaaagaatttggggaacattcaccaatttgcttcttcaggggcttgggtagggaacgtgaacaggaacctggctctaatttctgaacttttttatcagtaaaaacaatccaacaaacgaaagctagtcagtgagagaactgggagggtctgccctccttccctgagtcaagccttctggggggacctcctgacatttaattaagcaaagacaacgcccactgaaggaagctgacctgaaagtgacacgctactgtgaaatgagcatgaagtgggagcttgttacatatatgaaatggccagcgatcctgagcaaagcgcttcagagcttgagacctaagtcttctcatctatatactgagggctggacaagatgatctgtcaagccatttttatccctaatccaccaaaatccaatgctttagtttattgtcacaaaagcaggtatcgaatggctatcctgcagtgcctccaatcaacattcagactttttccctgaggcaatataagataacagttaacatgtttttatcaattaggtggtcatgagataaatatatatgggaagtggtagtttttcacttaaatgcatataataatggtacagctctctttgaatagtatttgtttatttcttaaatatttaagttcctaaagacggtaagaataacccaaggaagtgaaatcaatgtcacaaagcacatggctaaataactgcaggtttgcagtgccatgtgtgagatcagatgacagaagggagaactacctttaggcagaggcttctcatgtcccctggagtggccatgtgctgttctacatgactacttccacttcggttatgtagaagctatttaaagcacacagatgtttgtgatgagaaaaaagccacccttaattgaataatggaaattataagcatgatttgagggtgggggtggaggtgggagtagagatgggtagaaaggagtgcaatggaaacaaaggagccttcataaaattcaagtcacttcttaggataacgtgattgatttactcaccaccttcttaggaacataaagcaaacaagtgggttttccttttactgcttttctgaaatgagctacactcaagaaagcagcacgggggttgtgctgtccctgcacagtggcaggagagtatgaggagcaggtgaatgccacaacagctccatccaagatcatttttcacatgcaggaaccattcttatactaccctttactggtaatttctgtagaaatctggaagtctggttgacaccctcctgtacagtgtgcagtgaatcaacatcatttcccttggactttgcaatcacggtggcattcatacattcattcaacaagtatgtatgtacaggacagtggagtaaagaaaacagatagttcttactctcacgaggcttaaaatttcaggagggaactaggcagtcatgaagtaaacataaaaacacagattgtaataggcactagagaataatgaagactttggggaacacaatttaaattggaaaaatatctcagttccgttaacacatgttgaaggggaatagcattgttttgctggatttggggcctggatgcaagcatgttgggtatgcattgtagggtaatgcatttccttccatttgggcccaagtgtatatttaccacccagttgtgatgagctgggatcctcctgctcaatctcagcttgaagcacttggaggttatctgcctgctgtgggtgattattttggagcaaggtacttcatttgcctcaagaaacagatttgataccactactgtgcccttttggaacagagaagtaggcaagaccccagtgtgaggcagagtgatgggatctttagggacataattgatgatgtaactgatgatgattttggagtttatacatttccaaagtttcaaaatattttcacttggttgatttatctttatggtgatgacactacgtagatatatgcccttcttaaaagttacagtaagaggctgggagcggtggctcacgcctataatcccagcactttggaaggccgaggtgggcagatcatgaggtcaggagattgagaccattctggctaacacggtgaaactccgtctctactaaaaatacaaaaaaattagccgggcgtggtggcgggcgcctgtagtcccagctactcaggaagctgaggcaggagaatggcgtgaacccgggaggcggagcttgcagtgagctgagattccgccactgcactccagccagggcaatgagcgagactccgtctcaaaaaaaaaaaaaaaaaaaaaaaaaaagttacagtgagagttgacattgagaaaagggaggcccagccagggttatgcaaagacacagtagggaggaggatgggaagtttctgagacaccccagtaactgcatgggtccacaaagcacatgtacagtctgctctatgcactgcaggtacagccacgaataagacaaagtctctgccctcatggagcttggtgtctgtctactggagcagacaaaaacaaacctgctttttctcatttgcctctactgtgggttccgtgtataactctcaaatgctagcatttccatgcattccatccttgtccttctctcctctctgccttttccaggagaattttcctagccacaggttcagctatggtctatgtgctggagtcatacatttttatcttctgtgtacgtttttctctagacccatatttttaattgccttaggacagctctccctggatatccctcagacacaactaaaacatcattcaattgtactattaataattttcccttcaaaatccactcctcttctctatagacctaacagcaacactgtccgtccagctctcaaaacctgaaatgtgggagttgtctttgactcttatctttcccatgcatgagcactgaatcaatcagagtccctagcatgtcttggactgtggcctcccttctatcttcagattatctgcctttttagaattatggcaataacttaactgcaaagaccacatgtgcacttgtgctctttcagtttgtaataaatataaaatgaaaagtgattatgtctttgcttaacgtctgcaaaataaaagtccaaagtccttggtatggtctataaggccctcattatctgacctgcctgccttcccaatctcatcttaatcccttacagcctgacactcagacatactagactttccacctaactcactcacatacacctatcctgtatgtcaagattcggcttgaccttcatcacctacctatctgcagtatttttggatctgaattctctgcccacattgtactttcacatacttcttttacccttagtggtttgtacttatgcctggtctaactagattgtctccctgtaacagacttcttgattcaacaaagcagctctgaatcagcctgaaacctatggcacactgcaaaatggcaaacattcaataggtatttgcccagtaaatgttaatgaaaggaaaaaaattcaaacttcagttggaataggattagagacaagttaaaaaaaagtttcccatagaaatcttcctcatcgtaaatatcatcatcctaaatgtcccgagtctttccatgggtctaatttaccaaatcatgaagactctctttctcactgtgtatgtgtagtgggagaggcagagacagaacggtttttttttttttttgcaagtctgctctctggattcgtttttctggggatgaaatctcaggctatgtagcttttctggtccctttttggtaatcaacaaatcatcagtttctctaggtattaaaaagcctacacttttgaaacaccaagaggccaaactctctcttaattgaaaacataattctgcctcttactgaggtctttgggtgggaagcttaaagacagcagtgttggggcaattggtttttcttttcctccctccaccttctttcccattcaagagctgttgctgccctttctggaggggagggaattagaaaaaaagatcctgccttacccagtcactgttaattattactttgagccagggtggggaatgactttctttcctggaatacaccctgctggaaaccacagctgagattctctaagctggcagcttccaacctctcctccctcaacagcttcaacattatatggcactcagctgcagggtgcctggctccaggccggcagtccatttgtgcagggtagttttcaagatggctcatagcccatctctttcagtgaccagcgtggcctatgggaaacatacatcttgactccattattggtaggagtactctttagttaactgccacaggccagttcagacacgtcttaccctgagagccttttcagagtcaggtaccatccctgtgtcccccagcatctgaagatcacaggtgaaggtctccaagtagttcacttaaaaaatacctcagtaggtttaagaacagggaaagctcccaattcattctgtcaggagtatgactctcatccccaaactggacagatatataatatgaaaactacagaccaatattccttatgaatatagatgcaaacattctaaacaaaatactagcaaaccaaatccagcagcatagaacaaggtttatgtagcatggacaactgagattatcccaggaatgcaaagttaattcaatatacaaaagtccattaatacaacatattaataaaggacaaaacaacatgaaaatcttgatacagaagaagcatttaacaaaacccacagcccctcctttttttttttttgattaaaaaacactcagtaaactaggtttaataaaagaatttcctcaacttgaagcaaacccacagctagctaacatcatactcaatggtgaaagactgaatgctttccccttaaaatcaggaacaagaaaaagatgtctgctcttgtcacttctatccaatattgtactggaggtgctagccagcacactaaggcaagaaaatgaaataataggaatctagactggaaaggaagaagtaaaagtatttctgttcacagatgcatgatctcatatgcaaaaaatactaagtgacaaaaaaagaattttagaaaagctacaatatacaaaatcaatatacaaaaattaattttatttctaacaccagtgatgaatacaaaaataaaaattagaaaataatcatataattaaagtggcatcagtaaaatacttagaaaaaaattaaagacgtcaagacttgcacactgaaatctctaaaacatcactgaaataaagacctaagcaaatgcaaagacatcccacagtcatggaacagaaaacctaacaccattaaaatagcagttatttctcaaatttatctaccaattcaactaaatccctatcaagatcccagctgttttgcaggaattgacacaatgatcatataaaaattcatatgcaatgcaagggacccaaaacagacaaaatgattttggggaaaaaaaaaaaaaaaatggaggacttgcacatcccaaatctaaacttactaccaagctacagccatcaagacagtgcggtgctggtataacgacagacatatagggcaatggagtaagactgagaatccagaaagtcttatatttatggtcaactgttctttgacaagggtaccaggaccattcatggggaaataatagtcttttcaacaactggtgcttgggcagatggatatacagataccaatgcacttatgcaaaaaatggatgaaataggaaacttcactacattctactgcatgctcggtcattttcaatcatttaggtggcaacactgacaagataacagaaagatggaggtaataacatgtgaaaggcaaaatggtttgtttttttttttaaaaatgacagtctctatcatgaatttacttacactccaggcaaaggttattagaagaaaaaaagatgtaagaaaattccttaactgaaatgtggaaagagtatcaagaggagaccctaagacactctgtaagaatcccagtgactcctcactgttcaactaagaaatgtaccccattatgctgtgctaccacggaagcattggaggcactttgggggttgatgaagtcttcatggatgaggtactttaaatatctggtcatgaagagtatttgagaaatatgacaagtgaagatgctgggtaggaatgcagcgaggaaagtgtgtaacacaaggccaaattggaaaggtcagtgagggggcaatctgtggaggcactgaatgcagaggatattaaaattagcaagatagtgttctagcacaatgaaaaggattggaagagggagatgagagtcagggagtgaaattaggcagctgctaagaatgtccgggtgagtcagaggatcaggacctgtaagggcagtataaagaaggaaggaatgatgggagaggtttagggggaaagaagtgacaacctgtgacaattgaggaatgagagattttgatgattggggtgaaggttacatttcttaaaaagaaacaaagaatggtcggtcgatagagatgcaagatgaagaattttgtttttaggactactgactatgaggtaacaaagaaatcccagagacagaggtctgagcaaaagatatgggattggggaagaatctttgggagtgactgaggttgactagagggaactgggcaagaacaggtaaggactttaagcagaattggaggagtatccatctaaaatctgggtaaactgggatggaaaaacaagtagccagagaagcaacagcccaagctagggtgttgtcaaggttatagatgttactgattttggcaatgaggagattataaggatccttgaagactgtactttcggtgaaactaccatgcattagtagcctttcacagtgatatctaccccacacctgcatcaaaatcttgcagtgcctattaataaatgccaacccactaacggggaggggagaaaagacttgggactctgtacttgtaaaaccctctaccctccccaggcaattctttacacactaacactgttgaggtaaaaggagacaagtgagggagcaaatggaaggtgtgtttttggattatacagtggctcatggaagggtgggaggggtacagatggcccttagacactggcggaaagtcagagaaaaaaaattacagtaagcaggtaaagggatcaagactacacagggactagtcttgggacgacatttcttcctctgacagtttgtatggaattcttgagaaaaattcctcgaaggggcctgaaatctcagaatggtcatgtttttaatgggaatagggagtgatgctgccccattacaaccatctgttctaacagaatgtctgtaccgaggagggatgagtaacatcggcaagttctgttcgaagcctttttcaagtttctttttgatatgtatctatctatctatcatctccctatacaagcaagcatccccaaaagtagttgtctcaggaaaccagggttaggatgaccagctcatttgctggagctgccaaggtccagaaaagtttggctgcaggctgttttcatgttttatgtatgtttgaaatgttctataataataaaaggttaaaaaagtttacatttatttggaaaaccagttactttagtttatggttcctttttttccctccagagcttcctggagattgaggtctaattcaaagaaaaccaaaatatataatagagtacctgggcaaaaaaagtacttttataacataacatttggggtagaggaagtatccactgtagtcaaaatgtctatgttttgctcttccttattgttcagggacattccattaaatagtaatgaaaaggcagcaaaagtaagaggagtgacaacatgcccggcataattaagcaagctagagcagctattctgtgcaaccgacgattttttttctctaaaattttaagggtaggttcattctgactctgttaaaagtctacttgatgtgaacaactctatatctgataacctatttcaattaccactttaaaacttgtcatatggatacgttattacaattgtagaactttaataaataccataataataaaacttgagaactgaagagcacacatttcttcacgaatttattatataaaacgccctcagagtatttaatttctcctcactttaattacacattaagaagcacagtggatgagaagcctttaagatgactacagttgcacgaaggtccctttcatcaaggtagcgtatgtaccctaacagtgttctaaaggctggcccagaaaaaccccatgttaccttatcacaatatggaaagcattgtcttctttttccactaaattaaattatggtgaaaagtgccacagttttatttagcattatggtacataacaaacagttctgtctcaattatgaaaaaaattaattaaaataatcctgaaagacatcctttttctccccccaatgatttgaaagctgcatttttcctgccaatttcaaacaaacaaatcatcaggttgatctacagtaatcagttaaaacaatcagtcaatcaatcaatcaatcaccaaggcacaagctcagcacattagctatagcttgtagcaaaaggatatatcaatgtctcaccttagttaaaaatacataatccttttattttataatgcaataaaagaaattaacaacatcacatacacagaagactaggaaaggggaaactacttacttctggaaatcagtaatgtaaacctacttgtacttttccatagtacatgaaagtaacgtttaacatgttttgaattaattaattaaatttaatctgtggggctatacaatgtaattcttaggagtaatagtttcattcatttccaggtcagcttactgtatgattaagtaacacaaggcacagtagccatctttttcattatgttgcaacactgatcacgtgcctcgataaaatggctgattcaacaagatgatggcaacacgaaggggagactttggattgtctatttaaaatctaggtaataagtaagtaattaataaaaactctatcttaagtgcactttcacatgctttttgtttataataaacaaacaacaaacttcctaactttgttgcaataggcttgactaccatttcatttggccaaatgcactttccccagtaaacttaaaacaacaacgagaacaacaagaacaaaaatccctgtcctttcatatactaagaaagaggattggctactgaaacagttcattgcaagacacatgaagacgacatactgtggcatgagttgtttttgtttttaatttgttgtgctgttactaaagttctgagggctgcagttaaaacattccaatttctcccttccttccatctttctttattgattgattctcaagattttgcacagaaaactctttgggggctagaacagcagtaattgcatcacactgttttcaagacttcaagtttcaaaagcaaatcattaaaaaaaatacagttcctgatttgagttagatacagggacaaaaaagtagcacatacttgaaggttacgtggtctacaaatggtggcaatattttccttgggagagtagttctgttggtatatattttttaaatactcaaaaggctcaacctcaagcagtaataaacacaagcaaaagtgatttaacccttaaaataaatattcagaaaaacctctctgtacatacaagtgaaagaatatgtaacactttcacgcaaaaaaataattataataataataaaggatttgttcatatatgtagctgaaatctgctgttccagcccacatgtccccaataaagaagggaggcacagacataggtgactactgtggttgactatcttacagcctttttgtactgggacactatcaccaccaaaaatttatccctcgttatatttttaaaattttttaaattttttctttttttttccttccttttttttgttttattttgttttgttttgttttacagcatgccaaatcctttggcatacgtgatggccttcaacaatctctctttaagtttttctttgcttgagtattccggaagtaaaagcacattaaagcaagtatgagatgtaggtaacctaaatagagaaaaggggaaaaaaacaggaaaactgtaagtcatgggaaatacacttagaattaaatgctcctatttttagattgtatatagttgagacggtctgcaatgcaaactatacattaatgcaaatcataaactttttgttgtgtaactaccaagttgcctttatcctataaattactcaaagctagtgacgatgataagatactgtatccattgagtttttactacataacagataccattttaggtactgaattcttacagttcatttaactaaatctttccacaacaaaaccacagagaggacatcagtaaatgcactttagaggttaggtcactgagaagtcaagtaacttcctctaaggtggagaaaatactcaaacctgttttacaagactgcaaagtgtgtgctcttaaatgcttattagaaacactgctggcaatatgactaagaaaatgatttgataacaggattctagcacaatcaaatgataatcttccgagcctcaatgtaaccattctaaatagatgatcatgttatatggctttcaattaacaagctgggaatcaaaaaagtaaatgaatcacactaatttgattccaaaccaatgtgagccccataataatttttaactagggcaatttcttaaaagtttcctcacacaatgacagcaaagtattttctcaattgtctaatatgatttggggatttgtatataaaatcacgaatgtgctcagaaactataaagacagttcatatgtatgtgacgaggaatgcaaggttttcggtaggtatacagtcacaagttaataattacctacctttctgtgtctgggccatttttggctataatcatctttaattttcctagtcctcccacaggtgctctgtctgtgcccgttgtaaactgcaagaagagtcttttctgttcatctgtaaatgaatgaacgatttcccagaactccctaatgagaaaaaatacaatactggtttcagtttggcattcattatgactggtactaacataagcttatgatttgcattaaaactatattaagagacaacttggaagttaattatcaggatagtatcacttctggtgatttaaaaatttccaagcaaatttatcctgaacagctctgaatacgtaaaaatttagattagattacaatatagtaaaatattagtactacaatagtaaaaaattgagaaaacccaagtgtgtagtaacaggaagtgactatttaaactatggtataatcacattatgcagtcagtaatgagcaaaagacaaaatcctatgaattgaaaaagactgaaatgaatatttggaaaaattaactccaggtgcctttgggtatatattttatttatcctttctcctttattctcctggtctactcatcctttaactcaactttgggaggaaaaagtgatacagattaaggacaaaagaaaaaaagaccccctgccccaaccaactggccccaaatgcaaacaactacatacctaatagcagtaatacaaaagttcaatttttatatgaactagaatactttaaacaagtaatatgtgctgtgtatggaggaggagaattattctgacatttctgccacctgcagttattttaagagaatgatttatcctgtggcattcctaaaatctatgtaataaaagctatgttttaatgacacttatgttagtttgagttctaaaaaacgaaatacaagctcataaagtgcaatcttgaagtttatttgaataatcaggcatctataaaacatatatacactagttcatagctaaataaatttttttttttttgagacagagtcttgctctgtcgctcaggctggagtgcagtggcgcgatctcggctcattgcaagctccgcctcctgggttcgcgccattgtcctgcctcagcctcccaagtggctgggactataggtgcctgccaccacgcctggctaattttctgtacgtttaagtagaggcaggatttcaccatgttagccaggatgggtctcgatctcctgacctcgtgatccgcccaccttggcctcccaaagtgctgggattgcaggcatgagccaccgcgcctggcctatagctaaataatgttaagattaaaaaattaaaaaaaaaattaaaagtatttttagttgcttatataatataaaatgcattttaatagttatttagaaagttctttccagagccaggtgtggtggctcatgcctgtaatcccagcactttgggaggctgaggccagtggatcacctgaggtcaggggttcaagatcagcctgaccaacgtggtgaaaccctgtctctactaaaatacaaaaattagccgggcgtggtggcagatgcctgtaatctcagctacttgggaggccaaggcagaagaattgcttgaacatgggaggcggaggctgcaatgagctgagatcacaccattgcactctagcctgggaaacattttgagccatctcaaaaaaaaaaaaaaatttcatctcaaaaaaaaaaaaaaaaaaaattccagaatgttagcagagaacatcacacatcccaaaccagtaattacaattttctaccttttgatattctaatatcccaacatactatttttattaccaaaatgctggcatttttggtgctgcaacaccatttatctgaaataacttaaaagttttattagaattcttggctttctccaatctcttgccacttcccttccctgcccctttacaaatccaccagtcagcaagagaaaacaaaaaagaaacacacaacaacagaaaactggacatgaaacttgcaggagcatctctcaggtaaggaggagaggaatcggaccccagttcatgatactccttttggggaggctgacaagagaaaacaagtctgctgtagcacagaaccctccaacatagcagaaaagctgccctgcagtgggtggtaataaagcctcctcacactgcaggagggctctgaagcttaactgaaccagctacacctaaggaggtagaccaaagagcaccaccgaagaacagagacagaccctgcaggaagtggcagatcagcagtggtcacaatgaccagtctggctatattattacggagctgtttctttggacttttaaacgaaacctttaaaaattttatacaatgaaaacagggaacaaaatgcatctctattcctataagtgttatgtgtgttacattaacattttgaattaaacaagaatgcatatatttagaaagctgaagaaaacacgaagaagcttccaggtttccacataaaagtggtggctgtatcgatcacatcctactcacatctctaaaaatctacccggatcaaaaaggggaaaataaaaaaaaaacctatgacttaggtctagagtaaaactaggagacagaacaataaactccaaataccaaagaagtggggaaatgagcagggtccagcaggagctacatcgaagagtggcttgtgcggaatcatactgattagggatcacccaaggccagaccccaccccctccaccacctgcccctcaacagagcactactgagtgtaggttagagcactggcaacagggtggttaaaggaaggactacagaaaagtacttgggtccagcaatggcaggctcaggaaggcaccatgcatgaaaggaaggggggtaccttcaaaagcagaagtgtcccttaagcggctgtaaaggggtggaagcagctaatgaaaaagagtcttcattaagctacatggagctgaaaaatcagaaagtggtgattctgcccttactaaagcaacagaagagggatcccttcaaccaagacccctaaagccacacaattcctccctgctccaccatgaggtctagtaataacaggtccagaaaaaagtaacatctgttatagaaacataaacaagaaaaacagaattcggaagtctaaataaagttattatgggaagagtctggcgaatgagaagcaaaactttccggtagacaaaagtagaccagaaaaattcagtcataaacaatgggaaactagtaacaccacattccaacacaaaaggagaatgcagcagcagacaagacagaccaccagtgatgagaaatacaaattcagaaagaaatgagcacatcttaaataaaaataagaatactaaaaaatactgaagaaatatgcaaggtaactttggaaataaaggctaattttattataaggtgaccaaagaagaagcagtatgactaaaatttctactgaggacagactctagaaaattaaaaaacaaagaaaatgaataaaataaacataactaaagaaatgcatatcaaagcataataacgaaaaagattaatagctaactacataaacataaaacctttcatttggcaaaaaaatcctataagcaaggttaaaagacaaatgacaaactgggaaaaaatatttgcgaatttaccagcgttaaaggactaatctccttaacatataaagtttctaaaagtgaagaaaacgaccagctgagcagcaaaatgagcaaaagactatataaaactataaacagctctacaagaaaaaatgtccattatcattcataattgaggtaagctcaaaaattgtaactatagtaaaataccatttctcaattggcaaataagtaaacatccacatttaacaacacattctgtttggaaagttttaagaaaagagatactgttgtaaactgctggtgggaatgcaaaatgttatttttctgtgaaggaggatttggcagtatctagcaaaattacacatgcatctaccatttgatgcaacaatcccacttctaacaatttatcttaatgatactttacatatgtacggaataatgcatgaacattaagaggattcactgtgacattagtactaacagcaaaaggttaaaaataacctcgatgcccataaatattgataagctatgctgcatccacacaaaggagcagtattcagtcatacaaaacaaaatggaaaacacctctgcaataatgtgggatgattctcaggatacactaggaagattattttcctagttctgtcctctgataaggcctacaagcagtaacgttcaaaagcaaaggccatactttgcatctaaaatctgacttctaaatgccattctccaacaatttattggaaaaataacttattccaggcctgagaatgaatgttcgagattagttagaaatctcaaaatctaatagggtcattttaaaagcacacgatagctaagcaatttgaatatcatttagagtaatgactgtgaaacgtattaaatacaaaaacattcattagttcgtaatattcaaaaaggcagcaaaaaccaaccaaaaaacaaaattaaattgtcactattaaaattattacattaactccttactctaaaaaccttaaatctattttatcatgccttttctgtagaactgtttttcaaggtaatcaaatggcacccaatgatgagaaaaaagaatgccaggtatatatgtaggacaagcagatggaaattttttttccccaaacagccattttgcaatccccaatgagataacagattaaggtaatgatactgataaatacgaaaatcaggtgaagggcaggtagcaggttctggaaagatgatgatggcaacgacatagttattattattattattttttgttttattccctcccaacctcccctacaaaaacagcaaactgaatgagaaaaccaaagacccagagacattatctacaacaaaaccatgaaccattgcatataattggacagaaacaaagctctgacaactacaagactggttagtaaggaagcagatgcaaggtaactgactgggtttctgacagccctgagaacactgccaacccactggaaagcacaggccaatctgaaaacagggcttaaagttttaaaaagttctacaggatctaatttgcagatgattacaaagggatcatgatgtagtaagctctgggcccttaaaacacccgaataccaaacccccaccagaaacaaaccttgtaccgaggaaaaacttctgggaataacttccgaatggaccaggtcagtaataaaaaccaaaaaaaagttcaaatatatgtgtgggatagaggagtaaagaaggcagtttcagaaagcacaagggcatatttttgaccattttacaaaaacacagacttctcctcgtccctaaaaagcgaaaaaagttatcctggcccatctctccctcgtccaagtatgagaaactcatttcactcacacacacacacacacacacacaaataaataaataacagaacagagtgaaacagtgtaattattagagaaaaagtatgtgcatatacatgagaatggtgtccctacagaaaatcaaagtacatgaaacaatatgcaaataaaacatgaaaactgtaaacaaatttcaaactgagctaaaaagaatttaaaaaataacaaatcattagaaatgggaaatttctgaatgagggtaactgaaaaaaaggaagacatgacacaactaaggagtaattagaaatgcaaggaaaaaaatcccatcaaatacaaagaaactaaaactaaactagaagaaacataaaggtgaataaaacagaacaataataccagaacctgaaggcagaagaaaaatcttaaaatcaaaaagaaacaaacccatgcttgagactctccttgctggtccagagccacagtgctgctgtgtactggcaggaggaattctgctataattggtcctggcagtgttcacctttcctgcaagtgttccacagcccagggacacaatgtggtcaggagcactgccaggaacaccagcaagggggagcctgccacaacaggcacaaggctcaggaagcactctccagcccacgaaaatctagtgggggtcctcttccctcacccaaacacactctgcgcagctcagcctggagaaggcccctcaagcagcactactaggaaccagtgcgagccccagtggactgagataaaagcaacaaaccaaaacagcaccataaagcctctgaaaaatggtcactggaaccacagctcacaaatatatgctagtacctacatgctataccttaacaggttactactgaagttaaaatttttaaaaagtacagagtctcctgatataataactaaaatgtccgagacacaatccaaaaattatctgtcataccaagaaccaggaaaattacatgaaggaaagaaaacgccaacactgggatgagtaagatgctgaaattatctggcaaggatcttaatgctgccatcagagaaatgatttgacaagcaattacaagttctactgtttcaaaaacgaaacaatagaaaatctcagcaaggaaacaagatacaaggaaaaaaaagcaaatggaaattatagacctaaaaaatacaataggagaaaaataatcattagatgggctcaacagtagagtgaagatgacaaaggagagaaatctgaacaaaagagagaaaatagactgaaaaatgaaccatgcctcaggtccatgtggaacagtaacaaatgactcaacatttgtatcattagaggcctagaatggagaaaagagtgacgctgaaagaacacctgaagaaataatggttgaaaattttccatgtttggcaaaagacacaaacttacagcttcaagaagctgagcgaaccccaaatagcacaaataaaactattctttgggaataaagggaaaataaagtcatcttcagaaagagaaaaacaaaaagaatttctcactagcagaactgcctttgaagactggctaatggaagtaataaaagatggaatcttggaaaaaataatggaaatagcagaaacatgggtacatacaacagagcatcactcccttgataagttctataagtcatattggataactgatacaaaaactgtaatagcattaatcctcaaaacaatactatttaaaagtggggaaagagacccaactgaaattaaggtttccatatctcattccatgtaatggtattgatggcagtgaatggtggtaagtcacattatctataatgtgatacccacaatgaccgtgaaaacaactataaaaaacacatagaaggccaggcatggtggctcatgcctgtaattccagcactttgggaggctgaggtggacagatcacaaggtcaagagttcgagaccagcctggccaatatggtgaaacctcatctctaataaaaatacaaaaattagccaggtgtggtggcatgtgcctgtagtcccagctacccaggaggctgaggcgggaggattgcttgaacctgggaagccgatgttgcagtgagctgagattgtgccactgcactccagcctgggcaacagagcgagactgtgtctcgaaacaaaaacaaacaaacaaacaaaacaaaacccaaacactaaataaatcaagggtcttaaaaatcttaaaaaatgttcaagtaatcatggaaggcaataaataaataaccataaacagaagacagaaacagaaaacaaataataaaatggcagacctctccctaacatatcaataattaccttaaatataaatggtctaaataaaaaaattaaaaggcagagactaacagtttttattaaaatgacaactatatgctgtttacaagagattcgtttcaaattcagcaacacaggatgaaagtaaaatgatagtaaaagacagatcatgcaaacattaatttaaaaaaaaacaaatggttacactcatatcagattcagagcaaagaaaatcgcaaaacagaaaaaacttatataatgataaaggaccaatcaccaagacatagtaattctaaatgggtatgaaccaaatgatagagcctcaaaataaatgaaacaaaacctgataaacagataaatctcagaagcagacctatataaatattctcaagtgatttttaacgtatgtgaaaaaaacaattcaatgaaggaagaacatacctagaaaatacataaggaacccttaaaactcaacagtaaaaaaccaaatggactcttggtttttaatcccagagaaatacaaactttttgtttacaagtaacatcacagttaatggtaaatattatagtctctctcaataaaatgaggaataaagtaagaataccttctaccaaaggttctagccagtgcaatagaggaacagtaataaataacataaacattggaaagaaagaaacctgtcttgatttgtagatgacatagctgtttactagaaaaccctatgaaatctactaaataactactagaataagtcaatttagaaaggttataggatataagatcaatatataaaaatcgattttatttcaagatagtaataaacaagtgaaaagcagtatttaaaaaataccactaatagcattagaaacatattttaagtttattcctaaccaaagagtacatgatttcaacattaaaaactataaaacagtgctgagataaactaacaaacatctaaataaatggagagacgtacggtgttcaaggattggaagaatatattgttaaaatgtgaattctctccaaattgacctgccccagtcaaggcaacccaaatcaaaatctctgcaggctttgcccttttgtttgtaaaaattaactgattctaatatttatatgcaaataaaagtcaaagcaacctaatgaaaaagttgtgggactcacagcatctgatttgaagctgcagtaaccataacagtgtcattttggcaaaaggacaaaacaaattaatagaacagaatggagaatccagaaacacggctcacacacagattgattttcaacaaaggtgcaaaggcaattcaatggggaaagaaaagtctctttaacaaatggtactggaacaaataaataaaactatttagaaaatgaatgacatccactgtctaacagcatcacaaaattttattggtggtggatcacagatttacacataaaagttaaacctatattacacaattagaagaaaacataagatatttgtggctttgggctaggcaaagatataaaaggacataaaaaaccataaaagaaaaaataaattagacctcaaaaaatgaataatttctgctcaccagaagacacttaagaaaatgaaaacttggagaaaataatcataaactacttatcagaaatgggccttttatatagaatatacagtattccccacttacccatggggaatacgttccaagacctccagtgatgtctgaaattgcaaatagtactgaaccctgtatatactatgcatgatttatttttccttcttcacaatttcatagatacaatactcatttttaccatagattttagcaacctcaacatatgatttttaaattctttccttaaaggaagcactttccagcttctctttggcatatatattcgaatttccaacatcactgctcttgtgctttagggccattattaagtaaaataagggttacttgaacacaagcatgtgatactgcaacagtcgatctgataaccagtagactaaaagtggtgggtagtctagacaacaacgatatactggaaaaagggataattcatgccctgggtggaaaggtgggagatttcaccatgttactcagaatagcatgtaatttaaaacttaagagttgttggctgggtgcagtggctcacgcctgtaatcccagcactttggaaggctgaagtggaagaattgctagagtccaggggtttgaaaccagcctgggcaacatagtgagaccctgtttctacaaaaaaataaccaactaaaaattagctgcacacctgtagtaccagctactcagagggctgacgtaagaagattgcatgagcccagatactcagaggactgaggtaagaagattgcatgagcccaggagtttcagtttataacaatctgtagtcatgctactgcactccagcctggatgacagagactttgtctctttaaaaaaaaaaaaaccaacgaaccaaccaaccaactctccctgccctgcacccgccaacacacacatacatcaaaaaccctgaattattcatggaattttctacttaataaatatttttggaccactgctgaccaaagataactgaaaccaaaaaaaagcaaaactaaggataagacatactgctatattttaagaaaatatctatagtcaatagaaatacaaaaatccaatattaaaaatgaggaaaagacacttttagttaaatatgcacctgctatatgctttggaaactccactcctacatgtttgcccaggagaaataaaacatttccacaataagactacacagctttattcacaatagtcccaaactggaaacaatccaactgtccaccaacaggtaaaaaaaaaacactttgcgtattcatataatgcaacactactctataattttttaaaaggcactataaatcaatgcaataacatggatgaatctaaagagtcttcatgcagtacaagtacataagattccattcataagaaattctagagcagacaaaagtaagctacagtgacagtaattaggacagttattgtctgttctaatgggggatggagattcactggaagggaaaacatgggaactctgtgctgatggacatagtctacaccttgactgaaatatggttacataaatgtaatttttaaaaactaacccaattaagccctgggtatttcactgtattcaaattttaccccacacaacatcgacaccaccattattaccaccacattgataacattcagagagcagttagggaatcacattattttgaaaattagtaagtaatgggaaagaattaagcattatcgtatatgatatgtacatatttatatacatgtatacagatcctatatgtggatctgtaatttagggtagtcatagagttgatgagaaagagtttttcttaagaagtattacaggtaataaaggaaggaggaataaagaattcgagtatcacaattttgtaaccctcaatgaattagcagatctaggcaatcagaatccacgataaaaattactagaaaagacagaaagcgagtgagacttttaagttattcctacaaaccaacatctatgaagtatttgggaaggaaataaactctgaatctgtttttcgtttttttgagatggaatctcactctgttgcccaggctggagtgcagtggcacgatctaggctcactgcaacctccgcctcccaggttcaagcgattctcctgcctcagcctcccgaggagctgggattacagctgcctgccaccaaacccagctaatttttgtatttttagtagagacggggtttcccccatgtttgccaggctggtctcaaactcctggcttccggtgatctgcccgcctcgggcgtttttgcatgtattttttcaggtgctgaaaaagctctccctgatttcatttcttgttgactgcttagagacatctttccaaatgtccttccttgtcactttttcaaagttaggagcagggattgcacgtttttttgattggtaatttttgtttcaaaggtttgattcagattcagagttgattttgctaggtatggtggctcacgcctgtaatcccagcactttgggaggccgaggcgggcggatcaccagaggtcaggagtttgagaccagcctggccaacatggcaaaacccttatctctactaaaaatacaaacattagccaggtgtagtggtgtgcacctgtaaccccagctactcaggaggctgaggcaggagaatcacttgaacccaggaagcggaggttgcagtgaactgagactgcgccactgcactccagcctcagtgacagagcaagactgtttaaacaaacaaacaaaaaattaacaaaatcttatttctagtggtttacatattaatgatgctggcaacttttagttgaaatgtattaaacagcctcgcagtttttatttttatgaattctgcatacaataaataaataccaaccaaaatatctatacaggcataccccagagatactgccggttcagtttcagaccatggcaaataaagtgattatggcagtaaagtgagtcacacaaatttttttgtttcccagtgcttataaaagttacgtttacattatactgtagtcaagtgtgtaacagcattgtctaaaaataagtacattatcttaatttaaaatcattgctaaaaatgctaatgaagtgagcacattttgttggaaaaatggtgctggtagacctgcttgatgcagggttgccaccaaaaaaactcagtatctgcaaagtgcaataaagtgagatacgcctgtaatgtcttttttctcttctgttattacaagcactactttaagtcttcaactaccgaatacttgtagactatttaatgaattaatattttcatcatatttatattgagaaaattaagaagctgaatttagttagaaaaggtttagaatatcatcaactcttgaggatgagttggaagctactttatctgtcatttttcacataacactagtttgcccttcaaatcatacatttaaaaatgatcttaagatacataccaagtagggattatgttgttataaaaagctagaagtaaaattaagactttaatttcaaagataatttctctataaagaatagcacaagatatgttcaactattctcagagatgcatcaagatatgactttttttcctactagaaattatatctatgatcaatcatattacagagatattgctgttatactccttgtgactgatgaggggggtttttcctatcaccatgttatcccaaccctttaatgaatcacctttgaaactcagaacaggtagcagcacagaggttgctaagagtaaatacattcaccactgctgccagaaatgaccaacggtgcaccagaaagaagaaatactggtgaattcccacataccacgacgaacaaccttataaaataacagaacaaatgaatataaagtaacatacagccatcccttggtatatgtgacagggattggttccaggaccacgtgtgtataccaaaatccatgcacgctcaagttctgcagttggccctgtgaaactggcatgtatgaaagtcagccctctgtatatgcaggttctgagtcccaccaatactgaatctgctcttagttgagaaaaaaaatctgcatgtcagagggcccatgaagttcacagctgtgttgttcaagggtcaactgtaatataaaaataacatttattgctagatagagttgatattcattctagtgtttatatacttgagtcttagagcaatagcctttggagacaacttccaggaaggtacgtgtttgcatgccttctcactgcaatccatcagtagctgccacttgaaccagtcttagcaggggatggggaagcctatgtctttcagaattggatgatgtagtacacagaagtagacagtagagtagtaagggcatttgcttaaaagcagatagaactgggaacctctacatctttctgtgagaattcagggcttagttttttagggtgtaaaatggaaatactagtatgtatctggacatattatcttaagaattaaataaaagactaccatttcactcaaaaagtgcttgatcctgggaagccatgtaacagttcacaaatgcagagttcaaaagaaaggaaaaattgcagacatggtagccttattttaattatcttctaaccagcagtaagcatactctaaccagtgaggaatactagataatccatacgccaaatgcaggagattacatgagacttatatataacaacacttcattcatgaaataaatcacaagattagctctgaaaaatggtgattatattacaaatacaaatctaagtatatagatgacaatttgtgagtttgcttatttgggaattagtacctagagataaaggtctgaagcaaaatcacacacccctttggtgaatcaaatcttcctctgaagaactaagtacctcacctaatcagaacagagtccctggtatagccaccgtcatattctgtagtttcttctagtgcttggaaatctagattctgcaaattcaagaaaatatgtcttagttatctgctatactactgtatcattacaaacaataaatcgatacatgactttttgcagacacctgctttcttacccggcttccacatataagcaattcaatttcttctggtctgaataagtactttaagggagattcattggtcaccatatgaaaacctctccgaaaagccttgaactgtttttctactgatttattgagaatgtagtcagaataaagattgacaaattcctgtagaaaacattaatcacaagaacttcttataatatgctatgcaaacaaaacacaagttattgggctgcatagctttttaatttttccaagaaaaaaacattcaagaatattcttaaaaattcaattttacacctacttcttaacaatttcacaattctctgttatagccaatattaagctatgaaaaggccatatacataaaactgtcaagaatattcttaaaaattcaattttacacctacaaagaaaactacttcttacaatttcacaattctctgttacagccaatattaagctatgaaaaggccatatacacaaaactgtcatacttataaatgtcaatttcgataatgtattaaacagaactgaatataaatgctggagacgcagaaaattctttaggttctctcaactaggtatgtaaacagacacatttaaaccatgtatccatctatttataaatgccaaccgttttaagagagtacaatatatttgatttaagcaaaccaggaagtcccaagttttctaccatagaatatttggtaagctgcctactgtatccagttcagcaaaaatgtggaagtactgactgacacataaactactgtatcaaatcataaaaggaaaatgtgctttgtacccttagtgtgtataatatttaatcaaaaaattatatcaatataaacatgtttcttaaaggtatactatatatttgtcataattttttgcttgttatgttctgggttattcccattcccgatgaacacattttagtcaatagaaacccaaatctgacgtaaagtatacttttcagaaatgtatttttatcacaaacaggatatacatgtgtaaattaaatgtaatttttatttgttctgtgataaagaccttaatcatgaggttcctgcttacagcttaatacaagaaacaccctgcttcttgctttatactacaaccacacttagctattaactatctcctgcttcatgtcctctttctctaaaaggggctttagtgcccaactgtgtgctttcataccaacttatatccaagatttagaaaagtggactctagcatttacataaacttagttacttgttttttttttgtacagactatattagatacttctttaaaaattataagcatacatgctttgaaagtgttaatgaagagacaaaatgtgacataaaaacatttattaccttcctgttttcatttgtaattggaattttatcaccattttcctttagatcatacatcattgggttaccaaaaagatctgtctgtgatatctggaaagtgatcatcatgtcatcttccacattcccttcatactccaataaatcttttaaactctgatatagaacctagcaaccagaaatggtaaattgaggccaccatagaactacaaaatacaacaaataatttatatcactcttcttagaagacaacaaaaatcttatcaataaaaattgtaaaaagtgtagacagtatccctccagtcccccaaatagtttccaacctataaaagaaagattgtcagtcactgtgatgtcccattctctgctgagaaaccccataccaccaatttagcaatagaattcacactgtgctctatgagaaattctgtggtgtctcaaggtgggggtgggggtggtaggagcaggcacactcgttgtaactaccaagacccttagccagggctactctgatttttacctatctcttaagatttcactaaaacacaaacaaaatgtttagaaacacttctctatgaaatcaatcttacaaaagcttcgtgctgacagcaatatataaaaatgtccccctttgagtttttaagtgtttctggtacttcggtcagattaaaacatttttatcttattgataagagtatcaacaaagattctaaacaaaaactttaaaattttgacataaattaaatttttgcatttaaataaaatctaagagactgaattaaaaaaatgacaaagaacttactgggtgagagtctcccaagtcacgaaaagttccttttttccccattagcttcctgtagacaaccatgggaaaatgtacatccagtatacagttattgtaaatagccagacccagtactatgccaatcagagtaaactgaccctcagtttcaaaagaagatggattaaaccaaaacaattttgtagattcatcgtatgtgaacatacctataagaaatgatttttaaaaatacattacttttgtattttattaaggactgatgaataatacaaatataaacttaaaataattatgcatataaaacatttaaaatatatgtaattaggcatgcaacattgatttctattatattagcacttgagaaaacaatgtccacatatatctgctataaattggggtgaatggtgatatgtaattttatgaagccaaaggaataaagtagtaagtaatttggtggcatcgggtagaaaaatacgttaattaaattcaagctttctaattttctactaacacataagaaaagttatattcatgctttatccacccatagctgaaaaataaacataaaaaaacaaaaaatggctacatttccaaagtgtttcatttataaaaatataattacttatatctgtaccacacgtactatttttgaaaacaatttttcatttttttccttgagatggagtctcgctctgttacccagggtgggctggagtggcacgatctcagctcactgcaacctctgcctcctaggttcaaacaattctcctgcctcagcctcctgagtagctaggactacaggtgtgcaccaccacgccagctaatttttgtatttttagtagagaaggggtttcaccatgtttgccaggatggtctcaacctcttgacctcgtgatctgccagcctcagcctcccaaagtgctgggattacaggcgtgagccaccacacctggcctaaaaaacaatttttaatcacagtaaagaaaggttcgttttttcaaaattagacaatggtgccatgaaatttttctagcattttcctaataaaatcagatgatctgaaatacataaacctggataaatctgatgaacttagataaacaaagctattcaatacacatgttaattatgggccaatacgtaaaagaaaagtagtttcgtagtctttcaatttcacatggtcttcactatgcaagccccaatcatggaggcttttttttttttttttttttttgagacggtctcgctctgtcgcccaagctggagtgcagcagcactcagcttagtgcaagctccgcctcccgggttcatgccattctctggcctcagcctccggagtagttgggactacaggcgcctgcgtggaggccttttttatatcactcattggaaaattggggcccggtgtggtagttcacacctgtaatcccagcactttggggaggctgaggcaggcagatcacttgagctcaggagttcaagaccagcctgggcaagatggagaaaccccatctctacaaaaacacaaaaaataagctgggtgtggtagcatgtgcctatagtctcagctacttgagagggtgatgcatggggatggtttgagtcttcagcctgggaggtggaggttgcagtgagccgagacagaaccactacactccagcctgggcctcagagccagatcctgcctccctccaccaaaaaataaaagattaaaaaaaaggaaaattggaatctttggaatgagtactactaaaaattgatttcttcccttttaaatgactaaggaaaaaaattttaattgaatttaaatcattttactacatgtttagttgctactgtgaaacaatgaaaacatcttaagaattaagtctgaaaaaaatctgtaatttccaatagaaaagtagagcttagaaatcagaaatcaaattatacagtatataagtattttaacctgtttataagaattttaaaatctttgaaaatgtcattgtcactttaagtttaaaaataaggagctttaacatgtttccttgatcactaggagtatgaattaagcttaggacattttctgaatgcaaaatggtttgaaaattaaacaattcatatttgagtttcatggtttctatctaaacattttttttacaggccaagttacaacatccatggaaatgcttttagttataagtatggtattaacaggatcaagaacagctgacaaataattacaattaataaatttgttcaagctgacaatggtgtgtctaaaaaattaatgaatttaataaaatgtcacaaatgcccttccttggaaccaagagcaacaagctataagttaatcagaatataactctgaagttccattttaggcacattttctcatgttccagggagaaaagcaccataacctcctggtaaaatactcctttttgatacttctactgccatcacttcagttatcttactggaactgcttaatctatgttttttcttacaagtatttctgcatataatgcaagtatgctttatagctaaggtttaacatttctagatacatcaaaagctagagctaaggtttaccaaatttaagaactttatgaagtttataattttctatctcaaaaagggcgtcgtcttatgtatctctgatttacttagaacaaactacatacaaatggcatagctttttagttattaataaaacactagctagattatagataagggatgcgtgtgtgtgtgtgtgtgtgtgtgtgtgtgtgtgtgtgtgtgtgtgactaagaacagtaacagaaaggtcaactcaattagaatcaacaggctataacagctcaaatctcaaagctgaagggaaatgacatacattattctatgcacactcctcacaattctgatggtaccttcagtggaaaccttttcctgtaattgtcatgtactcaattttaaacgtaagcaagctcagttactaagtggttatatttacagtagaaactgaaccagttcagaattatgaagttaagtagactacccaaaagactgcatcttttccctgttctactttatcacaaaagggaaaaaactaaaattctgatccttcactttcaaatttccaaatcccatcagcctttcccaaactgtgttcaataacaactcttctgttagggcagaaaaagagttctggagttcaaaaagtttgggggaaacactacctatattaagccccaagaaatcttatagcaaataaacctaattaatgtgatatcagctagtgtttctgaactttgagcatgacatacttgtgagacagtctctcaatactcttcaaaccattgttctttgaagttcacaggtcaggaaaaccgtgagtttgatgatggttttagacaacaaaaagcaaagaaatccctccaactgttccaatataccattctaaagtgctttcaattcagtttaccaaagagataatttccttcattagaatattccttctaagaaataaaagaatttgaataaattagtgatacaaatcagttcctaaaacctacaaattcagtcatgatgtgtgattctgggtaatccataccaaatccttcttttgctgctcttcatagctgaaaatatttacaaagtaagataaacaaataactaactcaaaagatgatacgacaccataatcacattactaatgtatttaccaatatctggattgaagatttcctccacaaccagctgaaaaaattctttggaaacacctccctcatcaactccttgttctccttcaaattccacatacaactgcttcttcaagtctgcaggattttccatagcgatcatctctagctagtgattgaaaagataaacatgaaaagaagatgattgctagtatcaggaaaaaaacaaaataaaaacaaggagtaggattaggaaacaaatacaaatttttgactttttgtatgtaaatggaaacagaaagcaaactgataaaaagccagtgaagacaaagattcagtcttaaagataatcaaaaagacagacacaaaacagacactagcatagtaaaaagctaactttactgatttgttatgaaattaacatacaattaattaagattttattacttgtgtgttaagtctggactacacaggacatggaaaagcagctaaatcatttcagcaaaaacaatggagtagaggtctaacctcaaaattgttcattagtagtcctttattagaatagaaactcaagggttaagtcttagtatctactaagtcataagtaaaatatttcaattaagaaaaatacactgaatactaaagcagtttatggtctctcacagtaagacttagtataaattaccaccttttaatggactagaacccatcttatatccacatttccttaaaaacaggtgagacataaccttactcatgtccttactctttttttttttttttttgacatgaaatctcactctgtcgcctaggctggagtgcagtggcgcgatctcagctcactgcaacctccgcctcctgggttcaagcaattctcctgcctcagcctcctgagtagctgggattacaggcaggcgccactacgcctggctaaattttttatttttagtagagatggggtttcactacgtttgccaggatggtcttgaactcctgacctcatgatccgcccacctcagcctctcaaagtgctgggattacaggcgtgagcaactgcacccagcccttattcttaaattgtaagttaacaaactttagtgtctagcattttctcaactataaatcttttaccaaatatttttgtgtacctatagaattatgaatatacagtaacctcattgagattaatcataaaatcaacactagattccaatattaactgtttatactgcattttgtttgttttactttatgtatctaaaatttgctaacagtatgactgtatccagtacatggatggatactgtatctagtacatggatggatactgtatccagtatccatcatatctcctaacttgccttcaaacatctgttggctggttaaaaaaatttaatcttggagatgaaaatttaccaaaacaggatattaaatgttttcaggttattccaactatttcaaacagaattttaaaaatggttttgaaaaatgcaataatcactgaaacaactgtaacacagcactatagtagttaaagtaataatactcatttggacaatctagtctgtctacaaaaaataaaatctcataaattaacgcatcaggtcaggttgcccgagagcattgttttttcaaacttgtcacctgcaactcattagtgggtagtctaatccatttagtggtttgcaatcagcaatgggaaaatcagaatgcattccacatagtaatggaacctactgttttgtgaaacttttgtttcaattagatgtacagatggataagcatgtactgggatgctatgtaaaatactagggattgcagtcaaagagtttgacaaaactagctgaaattatcttctgggtatcttcaactttagggtcctattctgtgaatttagtctttagctttaaataatgtctgttgttgttcaacaccgatctctaatatttacaaaatcatttttaggccacacagtttacttttagacaatgttttgttatggaaagaccaagagtcagtcagaattcaccttactagtcccaactctcacttaccataacttttaacctttaaactttagcacgcgattcaattaagcctcagtttcctcaacatactgtaagttgtgaaggcttattaagaatatatgagaacgagtgttaccttttaaaatagttttgctctctgaacaacagatttgcaattttgtgtccccaaaggaacttgatatagactagttccaagatctagagtcaaacaaatgtagatgtgaaaataaccttggggaaaaaaatagtttcagttggaaacctgtttcaagctacggagtatacagaattctgaggagactaaaattagaattaacatcttagctcaaatgtgggaccaggccaacattccatattgccatgtaatccattctgagtttccttatgccagttcccaactggctaggtgttaaagatgtaagtcagtgtttatatttacctttacatccaaaggtatacttgcttttatcaaatataatgtattccaaagtggggaaaaaaaaggttatctggtatttagactgtgcattctacagcttttccccactaacattcatagatgagagctgactccttatcaatgtaaaaccttttaaaggatgtggtggtgaatttctacaggattgagaggccctgtgttctatctagtcttagctctacctaagacatgtcaaatgataactgaagcaaatttatctttattctccataaaatattacatgtctgtccacttccactgatctctattctatgctccccaccttggtgccaaaagaatgtaatgcaatgcaatatgttctattgtaaatgcaaacatacaactttacctctcttatttcatctgtaaaataaccataataatatagtaataaattaatgtatgaactgcttagattaattccctgcataaagttagtgcttaaaagtactagctgttgttgctgttattttattggttctaaaatattttctgaaaacctaccatagcattatagaacaaaaatattccatgaatacagcaacaataatatatagcacttttgtagcatttcacacatagcaactaatttaatcttcacaacacccttatgaggaaggaaacattaactccactttacagataaggaccccaagatactgaaaggtgaaataacttcaagtcacagtaagtcacagtaagttgtggaacagagatactaatccaggaaacaagctcttaactactatgctttactcactctcttcaatgacgaccaaaaattttttttttaggattatgagtgatttttattttccttattcttttccatatttttccattttttacaacaaatacatttttcagagtcagaatgtgttcaaatataaatatgtaaaaagaataatttgaaaagtagttggtaactgaattctgtaggcaaaaattttgttattacctattttagattaccattctggtacacataagtgatttcataaaatactgtaccacttaagaataaaggctgggcgccgtggctcacacctgtaatcccaccactttgggaggccaatgcaggcagattgcctgagcccagcagtttgagatcagcctgggcaacatgatgaaaccttgtttctacaaaaaactaataaataaataaataaataaataaataaataaataaaaaatagtggggggtggtggcatgcgcctgtcatcccagctacttgggaggctgaggtgggaggtcaaggctgcagtcagtagagatcgtgccactgtactccaggcctgggtgacagagttaagaccctgtctcaaaaattaaaataaataaaatagtaaaaacagaatacataaatagcctttaaaactattttattttaaattattaacacataaaatttagcaataaccattttgataaaggccattattgcataaacagctgtactgataattctttttcttaaaaataacctccatcaattgttcggtcaatttaaaaaagatttaacaaataaactgtaaaggtgtattctttacataatagctatattatttaaaattgtatgttgttgtttaaacccaaacctcaccataaaactgtattttttaagtcagaagttgttttaaatgcattaggatatttgaaatttggaggactatgtctaaacattctgaaaaggagaacgtgcatgcatgcctgaatttatttacaatacacacgtggatttttagggttttttttgtttgttttttttttttttttgagacggagtctcgctctgtcgcccaggctggagtgcagtggcgcaatcttggcgcactgcaagccccgcctcccaggttcatgccattctcctgcctcagcctcccgagtagctgggactacaggcgcctgccaccgcgcctggctatttttttttgtattttttagtagagatggggtttcactgtgttagccaggatggtttcggtctcctgaccttgtgatctgcccgccttggcctcccaaagtgctgggattacaggtgtgagccaccgcgccaggccaatttttaggtatatttaaaagtacagtgtatgttgtatttatttaacatggagactagcaacagacagagattactggggaaaaataaacaaaaatatcctggatataatcatatctacctcttcactgcgtaacttcctcttctttaagactcttgatttcatcaattgctggataaaatgatttttaatttctgaactttttaattggccatgatgatgaaatcctagggagttcattttttaaaaaaaaaatctgacctgatatcaaagcatttgcagaatacctagcaggatgacatcttaatatcaaaatatgatattactagacttacaggaatcaaaaggaaaaccttatcacttaaaatcttatagttttctgagctattacatcaaatcaattcataattttttaaaaaaattccttaataccatgaatatttaagtagaagcaataatcagataaaagagacctctaatacttaagaatgcctgggatttctaagaaaggctagcttcaaggccgggcgtggtggctcatgcctgtaatcccggcactctgggaggccgaggcgggcggatcacgaggtcaggagattgagaccatcctggctaacacggtgaaccccatctctactaaaaatacaaaaaaattagctgggcatggtggcaggcgcctgtagtcccagctactcgggaggctgaggcaggagaatggcatgaacctgggaggcggggcttgcagtgagccaagattgcgccactgcactccagcctgggtgacagagcaagactccgtctaaaaaaaaaaaaaaaaaaagaggaaaaagaaagaaaggctagcttcaactacttcagtcaacttgaggcttaaactattgcttgagatttccagattatccaaattaattttttcatgttcacgataaacacatgaagaaaagtctgttatatctcaaatgtagtttaaatgtttgggtaacaccaaatcacataatcacgttcgtccatgagacctggaatcctgacttctatttccaattctgccattaatttatgtaggctggaatctcttttagatttcattttcctcacatgtaatactaagtttgatgtttcattgtcttaaattattatataatgctgaggatctatgtatatataggcttcattctctcattcagtttctgagaaattactttgagggcataaaccaagcatatttcttggtttcatttttgatttcaattagaataaatcacaagaaagaacaatggaaattacatgttaaccacaatatagtgtatgtgtaagacaaaattaaacatacctagtgcagcacagaataatctcatttttaaagctctgtgagtcaatgaataaataaaagaattacgttcatgtttcactagtaagagtgttcaccaatgctggaagctgggagctgaaaatgctggaagctgggttagactaggctattagaaaccagataaaaagggccagtgacttttagaggggattttgcagaacctcctggtagtggggctttttatctgtgccaatcacctttatctgtgctaattcctatttttgaacttccctattcaattccacatctcagccattccttttggtttttagatatttatgtgaaatgctagaactccctgactaattggaaccaagtttcacatcatcatcatcctctattccaagcttgctgtccccatgatcctcttaaaaatctgagtttccaaaacacataaacatacttgtatatcaaaatggcctttctctttctctctatatatgcacacatacacacataaacacacatgcacacacacccccacctgagctgaaccaaaggccatcttcccaaatattggagtctggctttatcaaaatatttgtggagtattaccagaagttcagattcataggctctacaatacagcttctaatctaaacctctagaggttagggccctggattttatttatttatttatttattttttttaaacaattttcccattcagatgtgaaggcagtttgagggacctcatgatggcaatactatattcttccataaacttataacctctatcttctcctttaagaagtaatttaaaaaatcttaatacatactatcattggaagtgcttcatctaagaaaaatgagaaattatctacttgtaaaagaacacacaaatgggtatatttacatatttgtaaatatgtaaatatttacatatttgtaaatatgtaaatatttacatatttgtaaatatgtaaatatttgcatatttgtaaatatgtaaatatttacatatttaaattaaattaatttacatattaaattaaattacatatttatattaaaaatgtaaatttgtaaatatggttttacatatttgtaaaaacctcatcacattaggaatgtcattcaaatgaaaggtgaagtctaagctcatgtttatcactgtactgttttctaaggaacaataacgaaaaaatactgaaaataagtcctaggggaactatggcagtaagttaaacgggtagggtgggggtgttcttaagcagttctaaggtatttgtgaagagacaacttatattctattgattctaaaattcacttttttcacattatctctgaaatcagattacaccatacaaatgatagcatcttacaatgaattgctggtatttttctgtcttagcagtaataaaatgatagtgtttcctacaatcagagattagtgaaaatactatcaacatgaattcttctcttgtcatcaaagacaatttctctaaaaacctcaggaaaaaagctgctagtctggtttgaatttcacaatatataaaagcaatgaatatatttttcttttttaaaaaaatccacaattattaattcaagttaccactcctcaacagaaaacatacaagagtctcatatatgaagtcactattttctgggcttgatttctaaactaaggagtggataactctaaggtttcttttagctcttaaagcctaggatcccataattttatttatcaatattaagcttaccacaaagtttctcatttcttcttttccacccaaccctgctatacaattccaaaattagcaagtcataaaaaagtggccactagtttgttcactgtgatatataagaatgaggcttaaaaagcagagatccttgggaaataagatcttgaaaaattcatcacttttgagctttcatatgagagaataatcttaaaccactttctattatagaacttctactatgtgttactaaaatatgtggctttatcataatcatcacctgctgtgaatacttacttcaaaaaattacacaggttatcaattttacttataagacctatttcgatgctggtttttctagtcttttcacattctgttatttttttaaaaaaaagaaaaggaagaaaaagcaagggagaaagaaagttaagagtaaaatctgcttagtgtgagcattcagagcccctaaggaagcttctctgtaagcatcatctctttctattttcacagtttattaaactgcctaacacacatgatttctgaagtgaactgcttttgtgggctggcaatattcaagtacatatactatctagtgaatcctgatttatgataggccacactatattatctaattttgatataattaagcagaacttgctaaaaacaagttaccataattaaagagctcacagttaattttacactaacacctaaggctttaaaagcagttgtttccttaaaattctagaatagaatttaaaatatagaataaagtatataccaagtacttaaacttttgtttttagtcttgctttactagagaaaaaaatgggggactgaggaaaataagactgagtagacttctgagcgaaagacagataaggaaggtagacaattttttgaaccctggaatgattcttacagtgtaatttcattgccttttaaaggctagacatagcttttgatgaagacagctgaagggatctcacctcaagaagccaaacataaagtatgtagctttggcatttgcagttctgctccaacaatggatagtcatagacagacctcaacatacctttcataaaacatcactcacattcttataaaataccctatcattctgctaaactatgtaaagtaaggtgctggctgccttatgatcagtcattaagtgtattaattattcatgtgtctcaaaactatgtaagtgaaataaaaagggtaccagaaagcaagcaataataatgacttcaggcagttaaagcccccttttgtctctgctagaaaaccacctgagttgcttaaataatgcagaatctttctccaacactataaacatatctgacattaaaaaaaaaaaacaaaccagtaacaaaaaaaaaaaaaacacacaaaatctctgcaatttttaatttctgagatgtcaaataactttttccaccgggctacagctttatgaattctcgaatttagacaattctaaaactaaaatttagacattctaaaactaaaatacattttaaagtaaaaatcacatttcctagttgtctgtgtcagacaactttactagtatactatagtattattaactaccttaatttttgttgacattaaattttacttgaagatgataaaaaagtagcagcaatgacagggatagctaatactagaaatacaataaagctctgcgataatgcacctgagacaaatgtaaattttggtgaaatgtgactgacgactgctttctgtcttctggccactcttatattcttaaacagatacactaaaattatcttgtggaggaaagaaaaggaacaaatggcaaccccatctggaaaaccaggaagttaggatgagtacctgagtttccagtatttccctgctcaatctccctggacttgatgttacaggcaccactaatccccagatttttggaatagctgctgttttccagaagttccaagacccagagttgtctctatgaatttttaagtgggaagaaactaccacagccaggcagtgccgtccacacagggatattctaagtggcccagcaggactcaactcttactggcaacaggcactgatctgccatggtcacttcatcaagtccacaataatgcaactctgaattttacacgatggaattttttggacactacctataattttatggtatggttttactgtaccattactcccagttcaagactgcacatccacacttattattgggtatctccacatttctcttgttctggtctttgtccaacactctattctcttctgaatgaaagaaactttggatttagttttcaagatttagaaaacccattctttttcaaagatagcatgaccattatataatacaaccgatactttgtagaacacatctataaacttgcacaggaacaacaaaagtataatacttatataagatcagaaatgtccatgtgttcctatgctatatggtatcatttttttcagtcacttttaaaatgaattcactgaactgtatcatgatatccccattattaggtttttaatctagcagcccaacttacccggacaagtgcatcatctatgatatggtcacgtctaactttgagtctcaaatatggattcaactgctgtccttgaactaagctgtagagaacagtgattcttcgttcactgtacatgcgaattctattgtcataatataatcccaaattctttgtgacagcattcaatataaagggacatgtcataaaagagaatttgttctctgtttctactttgaaaaaagtataatctttatccatttctagaacctcattcagtggttcattaataaactcttcaaaagggataagtggttttcgacaatccagggttttaacaccaagttcagtttccagggggtccactcgaggacctttcttgtttcttctttcttctcccaaaagttcctgaagtgtcagctcgctggactcagggatgggctcttcatcatcttcttcattgtgatttgtgtccacttcccctcccactacatttgcatagtaaaccattttcaagcacttcgaagcagcaacaatggcatcatcatcattcactagatttcgactgttaaattcattgcttatgactttataagtaataagttgctgaaatgtctccatcattctccgaatctggtctgcattgtatttagaccacagtctgatcagttttccttgggctgcaaggggtagcttgctcatcgctttgcaaaataatggcaaagccatttccagatattcaggactgtggagatttctattctccattacgataatgaacaaattcagataattaggatctcgagagtatacattgtgatacgtcaagtcacattccacgttaggtgacaaatatacaagtgcattgagaaaggcagtttcaattttttcattagagagcaatctggtgtagacccttctaatggcatcaatatccacagacacatcatcagggcctaatttttgcaaattgttgtctccctgtgagctatcacctatccttgaggaagatgcttctgagtcttcttccatagcagcagcagaacatgcagctttttccttttcatcttcatctttgtcttcatcttttgcttgaagagatttcagttcttccttggtgtgttgtttaactttccggaagctctgtaccaatgcctcagcactagaaaaaactcttccaataacacggattaaaggggaataatcctctctttctctacataattcaagaatttcatataccttctcttctgttaagtaagtcacatctagaaaatcagaggaaaaaagagaacatttattttcataatatgtatgtttactctgttgcaaaaagttctaaaagtaaaacagccaaacattctaggctcaatatcatttatgatatacaactcttaaagtatctaatacttagattcagcaaacaaaatttaatgcttacctatttttttcaatgaactacctacctataccaatgacctcacccatgcttttacattctttcaacaatgtataactcttaataagatcatgagtttaaactttctttataatcaagatatctattaatgtatagctttaattataaatatgaaccaatatgtcatgtactgattaatcataatacagctcttaaaacctcactgtagaacacacagaaatactactaatctgtgagttttcttgtttcagtactctgttctccaaagactaagaaggcaaggtcttaaaaaaaggctccttcagcatctatgtatgtattaaaatcaaactggttcattttgggtcttcctagtttgttccagggtagtcattctgtgagtgattgagaagaatataccatttctcatcggctcttaagtagaaactgctttccacagccaggaatcaggttagactaaatctcatagagtgacagaaaatagtttttgagcaatgaaaacaaacagtgcaaagaagtaaacttatgagctggcaagcagtgcagagactatgtagtcatcaaaatctatttcctcttttcctgggcacagagttggaccacatttcccaactttttgagataagtgttattttcaggccaaggctttctcccttctggctaataggatgaaagatatttcatttcacaggtaaaaacaaatgatatattttgtgtactgaccaacataatactgagaatagtcttaattctcccttttatcaataaagtgacatacttgtcatcatcagattaactacttgagaggttaattttagaggcacacagacaatcctacctccattgcgccaaatatacccttatacatgtagtgtacaacatgtagaatttttaatgactcccacctctgctataatatatgtttcacaatgaaagacaatataaaatgtaagtgatcattgaatggtctccaaaaattgaagcacaaaaataccaaattttatcatactaaggatctgatctgtggcccagctacaagagtaccaacacttacagtttcttttatgggccttaactctttaagaactaattctcaggtttgttctattaagaatatataagcatcttttgctaaacatcagtaacctcttccccaaaagcataaaaccactggaaacctatttctcattattttcattgaaaatttttaaaataccttcttacaagacaatgcaaaactcctaatttcctaaaatgtaacataacagaaaatactactatcctattaggacatgaaacactttgcttcctgagcaagtcataaggttaacaaagacttgctttgcatgcagtaatatggcctgtcctagggatcaccattctagactcacatgtcctttgttgatatgtcatgctttcggaacatcttcaagtgattctgacagtctactaatcctatatagaatgtacctatactttttccaaggagtgttttttgttgttgttttttgacatggagtctcactctgttgccaggttggaatgcagtggcaccatttcggctcactgcaacttctgcctcccgggttcaaacgattctcctacctcagcctcccaagtagctgggactacagatgcacgccaccacaactggctaatttttttgtatttttagtagagagggggtttcaccacgttggccaggttggtctcgatctcttgacgtcgtgattcgcccgcctcagcctcccaaagtgctgggattacaggcgtgagccactgtgcctggcctgtagtgtttaatatgttaaactgaatttttcaggtatatagataaaaattagtcaaaaaacactgtaattagatatgaacattcaaaaagtttggtttattgatacaggtgttctactgagaaagacatttttataagatttcttgtgataaatgtgtccctgaaaatactcaatcttttaaattttgcacttaaaaacctcctacgcaaaaacagtttggtgcagactacttaatacttatgcaactttgtaattagtgttaacaaacataattaataatcaaaataagagtactagtgtacagaaagcatctctaatttccaatatacaatagtaactatagaacaatgcaaaaacaaaaacaaaaaaaccagtaacgaacagggaacagtaacagtagcatattagaaaacagggataaggaaaggtcacaactgctataatgcagacttgagcaaaaagaggagggggcataaagactggataaagccacacaataagcacctctaagatggagcacgtggccaaaagagcagatgagcacattcctcatgtaccacatcccccgcagctggctgcattccactgtgccagcactctacattcagttactggtactctctggtgcacacttactggagaactgtgtacaataaagtcaatgcagcttccacattatactgacacactatatatacagacaacatttacctattttcccatagtgtgtgaactaattcatgaaacagaattatacactctgaagcaacaaagttgtgtaaagtgacgaaaataattttattgtggaaacagagtagaggttataacacaatgccacttcactaattctttcaaacttgattcaaatgatgttagtgaaagttttagaggcaaatgcctctaaaattctctgacttgtatgtcataaaaaaaaagctttctctcttaaaatacaattgcctctgggtgtgtgtaggggtgagagtggaggggcgctaagccctggtagtcattcaaaaatttgattactttgttactaattaccttcactgaagaaaataacttggagttttagtattagcgacaaggtaatcgaattctgaattttggacgtaggaccatttagaaaacaaaagacctgagtgaagactgtcattggtaggtcatgatccttggcagcatgactgtaccaaatgtccggaaggagagtgagaagcatatatctgaaggaaacgtagaattctcacataactatcacaaaattttgtcttgccttcaaaaatggaaaaaacccactgtttcctctttctgcttctttcatcacatcatcctgaggttccagaactcatgccagatacttagtccagttattctataacttaaatagatgttgtggcctagttttggagattcactaccacttaatacatttttcctaagaattttaaaaagttcaaatcaatctattaacaaatgaacttttggcatatgatctgcttctaattagcaatgattagacctgtaaaatgtagttattattcctgtccgttaccacaataaaaaattggttctacgatatcaaaatgtctttatgtcacagaagaaaaaacaaataaaaactaatacatttaaatctcccacatggttttcaggcaacaattctcaattgaaaataaaacatcttacctttaaaatcaattctagcgcctttcttgttcatttttatctcagagcaggagttgttgggggcacctttcgagttctcaaggtaagctgagcttgctcctttcttggagggatgaggatcacagagttttgcattaatcttataaagctcgagggctttaatagctgctgcattattatccatacgaagaaaagttggacaggaagcacaaaactcattcgtgcaggcttcatttccacagccctcagttaactggtggtagtagcgttctattagatgctttgcagctgctcgcttcctgtaccaaacattcaaacaataagcacagtgattagtacagctctcaagtacaaagctcaacatatcatcaaggcaaaagttagtcaagcactgaagtgattaacctgtgtatgaagatgagaagtagaaaatggagatgcactatttaccacaactcctgactagtgaaatagttaataaatattttctaggatattatgataaagaatgtcaatgcttactgactgtattaacagagtatacattcctttggtttaaaaggggggaggggggcttgtctgatggtatatgtgcttaagttgtttagtacaacagctgaaaaatcacaaggtttacagctaagagttgtaggattctatcattttaaaaattagcattaggaaaatgagtctatttaaagcatcaatccggttttcttttacataatcagtatttcatttttaacagcttgtaaacatttgacttatagttaacacagaatatctatctggaataaaaactatttttcccaattatcaacaacatgggagacttaaaaataaatttgtaagtggaatatccaaagatagtgttacactgaaagaaagcggctgcagcctgagtgaggcagatcatgactgtaatcaatcccataactgtgggaggctgaggcaggccgactacttgagcccaggaggtcaacaccagcctgggcaacatagtgaggctactctctacaaacttttttaaaaaaaattagccaagtgtggtggcatgcacctgtagtcccagctacttgggaggctgaggatcacttgagcctgagagtcaaggctgccataagctgaaattgcaccactgcactccagcctgggcaacagagctagactttgtctcaaaaacaaacaaacaaacaaaaaccaaaaagaaaaagaaaaagaggctccaaagtgtagaatcttaaatctaaaacttgtcactaaacctcctcattagttccacgtcacaagatggaatattttaagttccatcacgtgaaatcttatattccttttactctgtcaacttaaagtacacagattaatgtcctattatggctgtttcaggagagctaccaaaactgagggaggaattatgtgaccatgtaagaagttagatgacattatattcaacactaaagagtctatgcttctactaactgataaaattaccataatttcagtagaataaactactggatccaaagaaacataagtcatagccattccttttggtcccaaattcacaagcatggaaataacaactacaaagaatcaaaattataagaaaaatagttcagctgattttcaaaacattcacagaattatctaacatgtaggactagatgaccaatgccagagtttacatcttgctaatcatgagaaactcaacaattaacaaggcagcaagtaagtgaagaaacacacgagatccaattttgtctcaacagaagaactttcactctctgtccaggtaggtgacaaaaagtgataattcacacacattcaattcattctggtgcttatttttcaaatgttccatgcaaatttaccactcactgcatgcaaacagagaaaaaagaaaacccacaaagcacatgtaaaaattgcataaacatgacttaaagacattttgctatctatgaagctataaaccccacctgaaaattaaaaactgttatcacagatttagcactatgcaaaatatgaaagtgaaaacatgtaaaaataaaatggaaatgcagaatctagaaaatttaaaatatatattgctacccttcagtaaagaaagggagataatgtcatgttctcccaaactacagtgacttccctggtgaaaatgtaagtaggtatttcctttctggaggaaaacagtgaacatgtatcgaaagtcttaaaaacacgaataccgtgtgaatgagatcctacttgtggaaaataatttgacaattttacaaaaatgcattgtttctatatctgaaaaaaacatgtctaataaaagattacttaaatgaactgataataggtcacacaataaaataaaaactatcaagatttgaattcgacaaagaactgcctagtcttcctgatatatcactaactgacaaaagtcagttaaaaagtagcaggtgtaggatgaacccattgttatttcaaagcattaatagcattttctctggatgatgtgattaagtgagttttaaaacttcttccatcttttgatttcttatttattctttccatagtaaggatgctacttgcatattaaaaattaataactataaggggaaaacaatagcagttataaaacttcatatacatgatttgaatggccccgagatttactaaattgtctctgatttttaaaaaaattacaaaagtcaaaataccaaaatagatatttttaatgtgagcttttatactaaaataacctccccaaaacttgtcagatacatagtacttctttatatactacataggaggagagtgatcagcacaaacagaacgagactgaaaaatcagaagatctgcattaagtgtcatccttctgtccctaagcagctgtaggatcctagggaaacaattgtctgggcctcagttttcccagctttatgagtcccttcagttctaattttaaagttattttatgtaatagggaggtgagcaagaaactagtatttgctggatgcctgataacttattacacacactgcggggcactttgacatgggttatctcatttgaataccatgacattgaggattatcttcagtccacagccaaagagagaaatagaactggagtcaaatcacgaaaccaagatctcaaagaaagtacagaaccaagacaagaataggagtccaggagtctttcagcttcagagtctaagtcattttgactatattgttttgcagaaggtgattcatttcaaaataattattttttaacatgagtaatactgaagaattctatggaaaaaaatctcataactaatgtgcaactgggaaaaaaatctgaagaatcataacgtgaacctcacatttatgcatctatctggtaccacaaaggcagaccaagtttcttgaggaaatggaaccactatattctgcaaagttaatttctctctaatttgttgaggacctatgtgctatgcattttatagacattcccactttagaggggaataaaccttaacagttaagagctcgcattctgaggccagatgcccaagttcacataatggctctacctcttaattaactatgtgaccctgaatgaattacttgatctttctggacgtaagtttcctcgtaatttaaatggtagtatctacgagcattatcatggtgagagtattattcttcttcacattaccaattgtgagaaaattaaatgtgttaatatatataaagtgcttagaacattgcctggcacatactaagcactatgaaagtgttagctactactattattgttgtaattgttactatcaccctcacaagtgtatgagttagcactataaaccttcattctgctgatgctcagagaaattacataagtcatacatctaataagagatttgaactcagctactaaacttgagcttttaataactattaagaggaggatctgaaagtagccctctatatttgatctgcctttctgtgccaagtttaacaaatagcagctacactgatgagacaggactaaaggaagccatgccagaacctccaagttaatggtggaatcaactatattaagcattcttcttttttcctcactccaatgacaccttaatttatctgacctcatctgcatcactatctaatttaggatatgtaaaaggcatacaaaatttagagcacataaaagggcctctacgttggaaaagtatacactaataacgactttttggtatagttcctgcgcaagggaaatccttgtaccatatgggtcaccaaatcatagctcgtaagtcaaatcgagtccaccacctgtttatgtctctcaagcttagaatattttacatttttaaatggctggaaaaagtttgaaaaataataatagtttgtaacgtgaaaattataagaaattcaagttccagtatccatcaagtgtactggaacatacccaagttcattgatttataaatatactatatatgataatgctttggctctgtgtccccacccaaatctcatcttgaattgtactcccataattctcatgtgttgtaggagtgaccccctgggagataatctgaatcatgggggcagtttcccacatgctgttcttgtggtagtaagtctcacgagatctgatggttttatcaggggtttccgcttttgcatccttctcattttctcttgtcactgccatgcaagaagtgtctttcacctttcgccatgattctgaagccttcccagccatgtggaagtgtaagtccaattaaacttcttttttttttcccagtctcaggtacgtctttatcagcagcgtgaaaaaggactaatacaatatactatatagtttatggctgtttttcatactacaatggcagagttgagtactttaggcctgcaaaacctaaaacaaataccacctgccctttacagaaaatgtttgccaacccttagtttaggatctattatttatctctgccctccagtgaccctgccatctaatcatttggcctcttaactctctctttaccctgagcaaatccgtaaaataaaaggtatacctttccccaagtactattaaagaaaagaagaggagaggggaaaagggaaaaaggggaaaagaaagtgaggaaagggagaggatgcaaaagaaaaagaaggaaagaaaggaatttccctgatgagatcccttagtaataccttatcagctgttcataatcaaaattcctagaagaggaacaacagcttacttgctataatttcttcacattccattgacttttcttattactcaaaaaacaaagtatgttataatgtgttgatttttaaaataaaacaaacttttcttatttagtcagcaatgaaggtcaagtgagaccttctagtaaaagtcctctaaagtcagacacatgaaaatacttatccatttaaaacagacaatactttccaattatttatttctatgattgaattaatgggacagtgctacaaacagaagtcctatggaataagtcatacttggaagatcagagtttactctagacaacttgacagcaatcagtttaaaaatggtttcacctagagggatgtgtactaatgttagcaattaactttgaaaggcataaaaattaagatggattgatggatacaaggatggttatacgataaagcaatgtaagtattaatggcagaatctaggtggcaggcatatgtgtgtcagctgtaaaatttgtgttcaatgtttttttagttcccacatatcagtgagaacatgtgatatctgtctttccgtgtctggcttagttcactaaaaaaatgaatttacaagacaactggaatataagcaatgaatacaagcactaagaagatgaagccatagaaacagctgccagaaagtgaagatgtgacagtgaacgccaaacaagtaagattagaattacaattagaatcagaaatgacaaaaaagaaacatgaactgtgagatgcaatataaaaactaatggtgaacaaagcaaagaataaaaaataaaaacggaaagattaaaaggaaaatgtgactgtaagtagagtgacctttatattatacagaaggtaaagcagaatgaacatgtgaggaatctaaaaaacagatataaaatagaaacaactgaaggcttatataattagtctataaagctaggaaccactgcttagtaatttctcgtaagtggagtctctttgttctgagacgttgcaaaactccattccatctcaaagttatttttaatgttaaaatttgtaagagtgagcaacggtatcctaaatagttctaggccttgtagaaatagactgtaagagacatctgtgacacaactatattcagtatgatgtagggtctgttacaatgggatgaagtgaatttagattatttcaagactaaacctacaattgtgaactcattagtaccatgaaccgaacaaaaacctattaaatatagaacaagacgattttcatgaaaaaataaatatgaacaaatcagtattttcagttgtttgaaatataggttaaccttcaattactgttttatggccgggtgcagtggctcacgccacgcctctaatcccagcactttgggaggccgaggcaggcggatcatgaggtcaggagatcgagaccatcctggctaacatggtgaaactacgtccctactaaaaatacaaaaaaaaattagctgggcgccgtggtgggcgcctatagtcccagctacttgggaggctgatgcagaagaatggcatgaacccgggaggcggagcttgcagtgagccgagacagagccactgcactgtggcctgggcaaaagagcgagactctgtctcaaaaaaaaaaaagaaaagaaaagaactgtttttttcatttttatagtctcaatatccagaatgcgtgatatatgataaaaaaaaaagtaaaattgtagaactaaatatttacataattcatctgtaaaatgaaaatctgttttacagtgtcatatttcacagttagaaaggaagaaaaaccttaaatcaacaaattaactttacatcttatggaattaggaaatgaagaacaaatgagactcaaacttaccaaaaaataaaaaaaataaaaataaattacagctaaaataaaatagagaaaaatagaaaatttttgcaatagaaaaaaaatcaacaaaattaggagtagctgttttattgaaaagatcaacaaaactggcaaattcttagattaagaaatgaagagaatagacacaaacagcaacaactggaaattagaaaggcgatacaacaactgctgccacagaaataaataggaccttaaaagactaatatgaacaactatgacccaaaaaaatttgataacctttgagaacggatagacacatcaaacccaccaagactgagccacaaatacatacaacttctgaatggacctataactattagagattgaatcagtaactgtccaacaacgccagggcttcactgaaaactctaccaaacatttaaaaactaacaacccttctcaaactctttgaaaaaactagaggacagaacactttcaaaatcattttatgaggtaagcattacttagatatcgaaatcagacaaatttacaagaaaaaagaatccctaataaatactgatgcaaaaaaaatcaacaaaataccaagaaacagaattcaacaatgcattaaaaagattatatttcataaattctcaactggaatttattcataaaatccaaggatggttcaacatacaaaaaaatcactttaatacactgcattcttaggacaaaaaccaataatctcaactgactcagaagaagcatttgacaaaaatcaacacccttttaggatttaaaaaaaggccagacagggtggctcatgcctgtaatcccagcactttagaagggcaaggtgggtggatcacctgaggtcaggagtgtgagaccagcctggccaacacagtgaaaccctgtctctactaaaaatacaaaaactaatcgggcatggtggtgggcgcctgtaattccagctactcgggaggctgaggcaggacaatcacttgagaacccgggaggcggagctggcagtgaggtgagatagcatcattgcactccagcctgggtgacaagagcaagattctgtctcaaaaaaacaaaaacaaaaacgctcaattcgctagaaagatatggaaattacttcaacataatgaaggccatatatagaaagaccacagctaatgttattcaatgatgaaaaactgaaagttttccctctaagatcacaaatggaacaagaatgcacacattcaccacttctattcaacatactgttagacatcctgccagagttagcaactgggcaagaaaaagaaatgaaaggtattaaatgagaaaagtaagaagtaaaattacttctgttagcaaatgacatgatcttttatgttgaaaactctagcctaccaaaaagaaaaaaaaccgttagaataaaggaattcagtaaagttacaggatataaaaaccaatattaagaaaagagttgcatttctaaatactaaaaatgaagaatccaaaaaggaaattaattttttaaacccatttaaaatgaaatcaaagagtaaaaaatacttagggaatattttcaccaagcaaatgaaagacatgtacattgaaaattaaacaacataggccggacgtggtggctcacgcctgtaaccccagcagtttgggaggccaaggtgggctgatcacgaggtcaagagattgagaccatcctggccaacatggtgaaaccctgtctctactaaaaatacaaaataaattagctgggcttggtggcgcgcgcctgtaatcccagccactcgggaggctgaggcaggagttgtcacttgaatttgggaggcagaggtgcagtgagccaagatcacgccactctactccagcctggtgacagagtgagactctgtctcaaaaaaaaaaaaaaaagaaaaagaaaattatacaacaatgctgaaagaaattaaagacaatacaaataaatggaaagacatccaagtttatgaattggaagatttagtactgttaagatggcaatactacccaaagcaatctgcaaattcaaagcaatccctatcaaaatcccaatggcattttctacagaaacagaaaaaaaaaatcttaaaattaatacagaatcttgaaggaccctgaatagccgtaacaatctggacaaaaaacaaagctagaggcctcacattccctgatttctaaagatattgcaaagctatagtaatcaaaacactatggtgctggcataaagacagatatacagaccaagtgagcagaagagagaacacagaaatagggaaaagaggttcttcaacaaactgtattgggaaatctggaatctaacatgcaaaagaatgaagttggagccttatctcacaccatatacaaagatgaactcaagctggattacagacctaaacttaaaacatcgaattataaaactactacaagaaaacatggagaaaaagcttcatgacattggacttggcaatgatttcttgaatagatcaccaaaagcacaagcaaccaaagcaaaaatagacaaactggggatacataaactcaaaaatttctacaaagcaaacagtaaatggagtaaaatggcaacctacaaaacaggagaaaatatttctataccatgtatctgttatttggttaatatccagaatatataaataactcctacaattcaacaacaaaaaatctagttaaaaagtggacaaaggacttgaatagtcatttttccaaagaatatatacaaatgggcaataagcccatgaaaagattctcaccatcactgatcagtagggagaaatgtcaattaaaactgcaatgatacatcatctgaaaccattaggatggccaccattaaaaaaacagaaaataagtattggtgaagatatggagaaactggaacccttatgcaccactggtgaaaatgtaaaatggtgccaggcactgtggaaaacaacatgaaggtccctcaaaaaatttgaaatagaattacctccagttccacatatgaagagcttggaagtcaccactccatcctaacaacaagtaaaaaatgacaaacttaaaaataaacaaatctgagataggataagtgaggtcacagggcaaatgactgcctgtgagagcagagaacaggtgaacacatagcatcaccatttatctgagatgaaaaacacaagcagaaacctccacggggtaggaaatcctgaagtgtaatagacaaattgatgaaggctcagtgtggacaactctgaaagctaaaaactccagagttacccaattatagggggagccctacaattttctaagttttacatccaggcaattgaccagcttctcacagtaaatataggagaaaaatcctcaaccctcagcaggggaggcaaagagaaatgattttcaagtacactagactattccagtcttaacaaggtttgtcctcaggagaaactagttaaccagagcctaacctgctggggttgtagcaaagccaaaatgatgtgggggaagagaaataacccaacttcaggccattatagctatcttgttctaactaagggaatgagggaggggtgggattgagaaacacttgtgaagttcacagtccagaggcataagctcactaaaaagactgacctaatcataagactacagaactcttctcctctccctacaccttacaaccacattactaaatgctcatttacaacagttccttttacctagtacatcatgtccaagctatcaagaaaaaaattacagggcataataaaaggtaaaaaacaagcaccaggaccagatacagcagggatttggaattatcaaacttggaatctaaaacaactatgattaatatgctaagggccctaacgaactgagtaaacaacatgttaaaaaagtagagatgaaaatcctaagaaccaaaaggaagtgctagagataaaacacaaacaaaaacaaaaaacagaacactgtaagagaaatgaagaatgcctttgatgggcttattagtaggctgggcatggatgaagaatctctgagcttgaaaatatgccaaaaaactacatctgggcataaaacgttgtaattacagaaattcaaggataagaaaaaaatccgaagtaagccagagggaaaaaatcaccttacctgtagaggaaaaaaagaaaaaaaagaaaaaatacatgtgacttccaacaagaaaaagagtgaaatattcatagtgttgagagaaaaaaaaaccataaacctagcactctaccttgtgagattattattcaaaagttaaaaagaaacactttctcagacaaaaattaaggaaatttgttgtcagtacacctgccttgcaataagtgttgggaagttcagaaactgaaatctacatatatagagcatcaaaagaaggaaacactgaaagtaaaataaaaccttttatttttcttatacttaattgatctaacaaataagaatttgttcaaaataatgtcaacaattgtgcttatgcatacaaatgctcctaaacttacttattgggttgtgtcccaataccattataaattgaaaatatcatgaaaacacaacttatccaaatttgtgggatacagtgaaagcagcgcttagaaagaaacatacaacactgatgcatttattagaaaagaattatctaggccgggcgctgtggctcacgcctgtaatcccagcactttgggaggctgaggcgggtggatcacatggtcaggagatcaagaccatcctggctaacacagtgaaaccccgtctctactaaaaatacaaaaaaattagccacacgtggtggcaggcgcctgtagtcccagctacttgggaggctgaggcaagagaatggcgtgaacccgggaggcggagcttgcggtgagccgagatcgagccactgcactccagcctgggcgacaaagcgagactccatctcaaaaaaaaaagaaaagaaaagaatgatctaaaaatcaattatctgagctaccaacttatgaaactagaaaaagcaaattaaatccaaatagaagtaataaaaattagagcagaaatcaatgaaattgaaaacaagatatcaatagagaaaaatcaaagaaatcaactagttctctgaaaagatcaataaaatcaataagcctctagccaggctaagaaaaagagacaaaggacaaaataactaatatcagaatgaaaagagtggacatcattacagatctcatggacattaaaaggataatcaagggatattatgaacaactttacggccacgaatttggtaacctagatgaaatgaatcaattccttaaaagacacaatctattagaactctaagaagaaataatcttgattaaaaagcatatattaaagaaattaaatccataattaataatgttctaaaagagaaggcatcaggcccagatggattctctgatgaattctactaaacatttaaggaagaaaccacaccagttctctacaatctccttcagaagacagaagcaaaggagatgctcctatctcattgtatgaagtcagcattactctaatacccaaaccagacaaagacattatcagaaaagaaaactacagacccatatttgtcatgaacaaagatgcaaaaatctttgtattagcaaagtattagcaaactaaattttactacaatgtataaaaagaagtatacaccagcacaaagtaggatttatcccaggtatgcaagactggttcaatattggaaaatcaattaatgcaattcaccatatcaacagactaaagaagaaaaatcacatgaccataccatagatggagagaagtatgtgacaaaatttaacacccactcatgatagaaactagtaaactaggaatagagggaacaccttcaacttgataaagaacgtttacaaaaaacatacagctaacaccatccttaatgatgagaaactagaaactttcttactaagatcaggaacaagaaaagaatatccccacctcaccactccatactggaagtcctagctaagacaagaaaaggaaataaagggtatactaacggggaacaaaaaaatacaactgcctttgtttgcagatgaaatgactatatgtgtagaacatagacaggaattgaaaaaaagaaaaagaaaaacaacaaaaacctcctagaactaataagtgattatagcaaagctgcaggatacaaggttcatataaaaaagttaatagctttcctgtaaaccagcaatgcataagttgaatttgaaattaaaaacacaataccattttacattagcgtgtcccaaaatgaaatatttaagtacagatctaacaaaattagtacaagatatatgaggaaaaatgttttagaactctgatgaaagaaatcaaataactaaataatgaagagctattccatgacccgtgagagacaactcaatattgacagaaaaagtcagatggacactactgatttcaagatttactgtaaagctacagtagtcaagatggtgtggtactgacaaaagaactgacaaaacagaccaacgaaacagaatagagagcccagaaatggacccacatagtcaaaggagcaatggcagtatttgacaaagaggcaaaggcaatacaatgaagaaaatagtctttttcaataaacagtggtaataactgaacatccacatgcaaaaaaaaaaagagtctagacacaggtcttacacccttcacaaaaataaactcaaaataaaccagagaattaaatgtaaaactcaaaactataaaactcctagaggataacataagaaaaaatctagatcttgggtttggtgatgacttttagatacggcaccaaaggtaccaaccatgaagaaaagaactgataagccagacttcattaaaattgtctacttgtttcttaaaaattgttgtcttttgcaaaagacaatgtcaagagtatgaaaagacaagccacagatagggaggaaatatttacataagacacatctgataaagaactattaactaaaatgtgtaaggaggctgggtgtggtggctcacatcccagcactttgggaggccaaggtgggtggatcacctgaggtcaggaggtcgagaccagcctggctaacatagtgaaaccccgtgtctactaaaaatacaaaaattagccaggtgtggtggtgcacgggtataatcccagctactcgggaggctgacgcaggagaatcacttgaacccaggtggcagaggttgcagggagccaagactgtgccactgtactgcaacctgggtgacagagcgaggctctgtctcaacagacagacagacagacagacaagacagacagagacagtgtaaggaactcttaaaattccacaagaaaacaaacaacccaattaaaaaattggccaacaaccttaacagacacctcaccaaagatatacagatggcaattcagcatatgaaaagatgtcccacacatcatatggcatcagagaaacacaaattaaaattataagatacctctacacacctatcagaatggacaaaattcagaacactgataacaccaaatactggtgaagatgtagagcaaaagaaacactcactcattgctggtgaaaaatgtaaaaggatagcgtcatattagaagacagtttggatgtttcctacaaaactaaacacttttaccataagatccagcaattgcactccctagtatttacagaaagtcgctgaaaacctaagtccacacaaaaacctgcacaccgatatctacagcagttttattcataattagcaaaatgtggaagcaaccacaatgtccttcattaggtgaatattcattcacaaactgtgatatgtccagaaaatggaaaaagagaggtactaacaacctatgaaaagacatggaagaaactttaatgcatattagtaagtaaaaatagtcaagctgaaagggctatatactgtatgattacaagtatataatatgctggaaaaggcaaagttagagacacagtaaaaggatcggtgattgccaaggagtgggagggaaggaaagataaataggcagaacacagaggattttggggcagtgaaaacattctgtatgatataatggtagatacatgtcattgtactttgttcaaagccacagaacgtacagcactaagaatgatccctaatataaactacggactttgggtaattatgatgtatcaatataggttcatcagaaagacatgtaccactctggtgggagatgcacactggctatgagagaatccatacatgtgtgtggaaggaggtacaggggaaatctctgtaccttcctctcaattctgtgaacctagaactcctgtaaaaaaaaaaaaaatctaaaaaaaaatagaatacatatgatccagtaatcctacacctgggtatacttccaaatatattaaaaacaggttctcaaaaaaatatttgtatacccatgtttatttcaacattacaatattcaagaagtggaaggaacctaaacatccatcaacaaatggttaaagaaaatgtggtatacatatataacaaaatgttattcagcctaaaagaaaagaaagaaattctgtaatatgctacaacacaaatgaaccttgaggacattgctatgtgaaataggccagtcaacaaaagacaaatacttaatgattccactgacatgaagtagccaaaacagtcaaattttagaggcaaaaagtagaatggcatttgccaaggaataggaagaagggggaaaagaagagttgttcaatgaatgtagagtttctgttttacaagatgaaaaagttctagagatctgctgcacaacaatgtgcacagttaccacaattgtaccgtacacttcaaatcattaatatggtaaaatgtgttgtttttgacaatttttaaaactctaccccattgttttctttacctcttatataaactgataaaaacctgttttatcttaatcaattattgtatgactactgctccccagagaaaaaagtgcatgtgaaatactactacttatccatctcctggctctgagcagtacatgtcaggaacaagagggaattgtagctggaagacagtagaagagccataggacaagtctctaagagaaggaagaaaaggcgcaatgaaagaaaacaagtttaagatagtagaaaagcattcaaagacggcaacctgaggtaaggtgttttcactgaagcttttggggtaaaacagttttgagttggcatgcctgtagacatgggaagcagcagtgatgcagaggtgaacattactgtagataaaaacggatgggaatttgacttgctagggactgaggggttaatcatataaataaagatggcagcagatttgggaaagagtgaagaagaataagttcaggtagcagtcctcaaaaaccgagaagaaactgatagctcactgaaggcagacagaggaagacaaaaccagaaggcataagcttcaaaggagcagggatttttatgctgagagagtaaaaggaatagttcaaagcagcagtggagaacacgaataacgttccatgtgggaaaagaacatgtccagagcttactgtacctataacctagcttctgtaactggaaatgaagaatctgctctagtcaggtcatcacttttcactacttattttacttggccttcctaagaaatatagaccttttggaaattattgacttttgggtctaggacactatttcttggtttcctcccttctctctggctgtttttcagagacttcccttccaaatctagagacatttgtattctccagggatcagctattagatactttcccttttaaatttccctttggacagtttcatctttcaaggattgagcaataactaaatgacttccaaatgtctacttcagtataaattctgcttgtcaggctacataaaaagggctcttcaaggaattatgatgtctaaagaaagagaaagccacgatttcaatatcacagagatgactacagaggaatagcaataaaaagagaggcaacttaggagaggtgaatcacaaaagatgactaggagctgatgacactatgggtgggaagaatgtttcagacaggggaagaatgtttcagatagaggaaaatgagtaaaagcacaggggcctgaaaacatgatattataagacaattccaagcacttcaagagcctaaagttcaagaaaagtttcaaaaatatgaaaatggagaggcagggaaaagccagatcatggaagacctcaatagccatgataagtaattctttttttagccaaaagaggagtaatctaataaaagctaaagatcttctcctcataaaaatacatgcacacttcaggagtgcaaatgcactcttccggaagattcgtaacccactacattcataaaccattagataagaactaaaacacaaggagtcactgaagggttttaagcaggttaagtgactgacaaaatttgccttttcaataactgaaaccaaagtgggcaaaactggaggcaagcaatccagttaggtaatgactactgtaatagtccggacaaataatgtagcagtaggaagaaaaaaaaagatgaaattgacccaggaaatatttaaaataagtagtttgtaagaggtaaataagctggaagagccagaggtaatgggtagggtttctggtatgggcaacaagatatgctacaagctgagatgttagtaaaaacaagcgttcatcagcatttagtaagtgatttatttatattatatcactgaatactcaattatgttaagaggcagacagcagttaaaaaacaaagaactcggtgaatcaaaaagttctgctaatttggggaaatagcatcccttttatttttgttaatctcttttgggtttgatcctcatttatagctgacaagaagttctatgtactaaaggtaaactattctcattaatgttcccaaaaatctcttggaataattaagatataaagaaattcaaaattcacatgattataaaaatctttccttagataatctcataatatagccatgttttgctcattctactttgagaagattcagccagaaacagttcatccattcaactatccctactgtgaactagaagtatgtttccttacatttgaaacagaagatataggtttatatgatgcttcaggtggtagaaaagcagggcagactatgactcgtgtcacttccttccacacgtgatgcctttcatgggctcctgtgtctgtcagaagaaagcaaagggccttagcgtgctcctggctttctatatccaaatgcattttttcacaccttctcccatcagctaactctacattactgcaatacggaacttcttactactcagtggacttgttctgctgtcttctctgattccaggtgttattcttcctgcctagaacactatgattcttagctattcccaagcatcctcaaggtttcagcttatataccacttttaagataattaggtattcttcctctgtagtctcataccaaccagtacctattctattatatataataactgcctattaattaaatgggaagctgaggtatatgacctaataacttatttactgtcgtatcctcagaacctagcaaattacagagtctcaacagagatttttcaatttctcttctgatactgtctcgataacagtgtcaattaaacctttctctaattatttgaccttgaagggaaatagatgtcagactacctcctggtttcgagtatactggaagcatacaaaaggaccttctcaatctggagaccaagaatatgatatgagaacctataggagaaccacttatttgattaaagagatttcttttacttcagaaaatatttcagtatgttacttgacccataaatgcttatagatgtgtaagtacaccgaagaagtcatataggaaataaaagcatccaagctatatttctatggtctactctgattaaaaagctcagctctcctatcaaattcaagataatgcatgtggattatggagcacagtcacttgctacatggtaaatgctcaaaaagatgataggtggtattacccacattctacaggctgtgtacatacttatcagtttatatatatacataaactgatcctaaaaaattcttcctacatttctgcaagataattaaaaaggcagaaacaaacattttgcataaatttactagcttcattctttcatgtaggaagtagttactgactacctactgtatgccaggcactgtcattaggcttccattctagtggtaaagaagcaaaacaacaaagaaatcaatatgcaagaagtcaaatgacattaaatcccatgaagaaaaatgcagcaagttaaggggaatgcagaagaacatgatcattctttgatgcagccggtcaggaaaagcatcatttgagcagagagctctctgaatcaagtgaggaaggaagccacatggattatcacagagaagggtcacagggtcacagacaatagttacaagccttaagatgacaaagatacagccattttagacagagatgagcaagtgcggtagagagatcacagaaatgaaaggaagccagttcacacagggccatgtaaatctccagattttacttttaagatgggaagcctctgaaaagttctgtgcatagtaaataacatggtttaactcagattttaaaaagatcattccggctgctactagagaatacactgtaaagcacaagactcctgggaaacaatttctttcttttgccaaaagatgatgcctttaaacagagtaaacagaagtataatggttaaaaaaaataaaatgaattatgggtatttggaaggtgtagccaacaagatttaccaataatttgagtatgtgacatagagaaattaaaagatgcttccaaggcttctggctgcacaggaggggaaaaaagctgttattgactgagatggcaaaatattatgagagacgtaggtttgggatgatgaaaatcaggagctccacttaggacaggttaagtttgagaaccagacttaactgttggataaatcagtctacagttcagagggcaagagctgacgatggaaatagaagagttgtcaatagacagagtcctggggcatttctgacatttacagtaaactgagcatttattaaaactaacttgctttactgaaccataaatcacttgttgtatttacccctgctccatttatagttatacatctggaaacatagccttagtgttagaggtaaagagtaaataccaaacataaaaaatctgatctggttgggtgcggtggctcaagcctgtaatcccagcgctctggaaggccgaggcaggcagatcacgaggtcaggagttcaagaccagcctggccaatatggtgaaactctgtctctactaaaaatacaaaattagccaggcatggtggcacatgcctgtaatctcagctactcgggtggctgaggcaggagaattgcttcatcctgggaggcaggggttgcagtgagccaaattgcgccactgcactccagcctgggtgacagagcaagattccatctcaaaaaaaaaatctgaagttactgagaaactggtatgaaatcattaagaaaactaaggtgtctaaattaatacatacaaagagattctacaacacggtatttataaatttaaacaaaatccatggccaggcacggtggctcacgtctgtagtcccagcactttgtgaggccaaggcagaaggattactttggggccaagagttcaagaccagcctgggcaacatagtgagaccctgtctctacaaaaaacaaacaaacaaacaaaaacactgttttagcctggcatggtggcacatgcctgtagtcccagctactcaggaggctgaggcatgaggatcacttgagcccaggaattcaaagttgtagtgagctctgatcacaccactgcactctagctgtatcacttatgacagagcaagacaatatctcaaacaacaagcaaacaaaacaaaaaactaaagtaaatccaggtaaaataaacatacgaataaatgaaaagatctgggttattgcattagttctgtttctaggcttaactacaaaatggtgtccagttgttaaaaacacttgtttaagagtattaataatttttttttttactatgctcttctacatcctaggaaattggcaacactaagaattcctaaaaacaaacaggagtgttaactgtatataaattattatttaagatgcattcaaggcgttacttaaaatatcaaatgcatgtcaaagtacaaacaacaaaatcatgcttcaacaaatgtgggatgttgccattaatggacagttagctctgaggtaaaaccaagaatccttcattacctatttttgtaaattaggacaaatactattaaggtattaggttggtacaaaagtaattgaacaaacctggacccactcacctcactgaaagtgctgcctggctacagtttctagatataggaatgtgagaaatggtagcagccttgaaggtttagagctatattcccataccaattatggctagaaacttaaaacagctctattgagacattatgggaagtctaatttcctgttactctactttaacacagccaagtaaaacagtaagaaagcttgcttaattcaacaaggactgagtgccagagtgtcacctggaaacttgtgacaaataatcatgcctcacacattcatccttggtttttactaccaaatgcaagcttcatctatcctcttccattctaaacttgactcatcctcctaacctcttccagaaagatctctagaaacccagaggctttctgaagacccataggctatcccccatcttcaactactttacataatggcccctcaacttcttagctttcatgaaagcctggctcctccccaaaggcactgcctatcatgcaacccttttatgtgactcctaaaactcctaagtccaccattattcttctaattccctgtattaaaaataaacggcaaaattccctgtattaaaaacaacaaaaaaacagcttgtaatttgaaactcatgtcatctaaccgaatgccttctctttccctccctgttctggtcaattaaacccacatatttaagcctccactttgcccccagttacatcatcagcaaagtgacttcaatgtccctgtacatggttctatcccaatactctaggcccccaaaatatttgcctttctaaatttgagacatcttcacctcctcatttcagcaaatcactcccttgtctttgttagacatactaaaacctctgacaatgatcatctcagctatctttgtaagagtttcactcatactcatatctcctttcacctgtcaagacaccaggtttggtgacaaataaaaatgatacgtatttgggaggctgaggcaggagaatcatttgaacccaggaagcagaggatgcagtggccaagatcatgctactacactccagcctgggtgacaaagcaagactctgtctcaaaaaaaaaaaaaaaaaaaaaaaacacaaaaaacaaaaaaaaggatacatatttattgtattcacatgatgttccaaaatatgtatacactgtggaatggctagatcaagctaattaatacatgcaatacctcacatacttatattttatggcagaacatttaaaatctactctcagtgatttccaaaaatacactgttattaactagtttccatgttgtacaatagataccttgaacaaattcctcttaattgaaattttgtgtcctctgaccaacacctctgcaacccagtccactcacccccagcccctggtaaccaccattttacatccctgagttaagattccacatttaagagagatgtagtatttgcctttctgtggctggcttactttcaacaatgccctccaggttcatccctgctgtcacaaatgacagcatttcctcctttttatggctgaagtatattccactgtgtatacataccacattttctttatccatgaacacttaggctgatgctgtatcatgggtattgcaaatgataccgaaaggaacatgggagtacagatctcttcagcgcactgattttattcttttatttatatatatatatatatatatatatatatatatatatatatataaaaatacatatatatccaagtgtgactgctgaatcatatggtagttctattttttaatttctgagcaaacgtcatgctattttccataaatgctgtactaatttacattcctgccatgcgcaatatatctcttgtctgcaaatcctcatcatactttaatagccattctaatggccatttgtatgtcttattttgagaaatgtctattcaagtcctttgcccatttcttaagtgaggtgctttcttactattgagatgtctgagttccttatatattttgcatattaaccccttaccagatatatggtttggaaatactatcttccattctgtgagttttttcattctgtagattttttctttttgccatgcagaagctttttagtttgatgtgatctcattcatcaatttttatttttgttgcctgtgcttcgagggggtcatatccaaaaaaatcactgtccaaaccaatgtcatgtacatttctcctatactttattctggtagttctacagtttcaggtcttatatttaagaccttaatccattttaacttgaatttggtatatgatgtgagatacaggtctgatttcattctcatgcatgtagatattccattttcccaacaccacctattgaacagacttccctttccccgctgtgttctttgcaccctgtccaaaatcaactgatagtacacgaatttatttctgtgctctccattctgttttgtgggtcgatgtgtctgtttttttgtttcttttgtttttaaaagacagggtctcacgctgtcatccaggctggagtgcagtgatgcaatcacagttcactgccaccttaagctcctgagctcaagcaatcctccttcttcagcctctcgggtagctaggactacagatacacagcaccgcgcctggctttaaaaattttttttttttttaattttagagacagggtctcactatgttgcccaggctgctctcgaactcctggtttcaagtaatccttctgcctcagtctcccagagtgtgggaatacacgtgtgagcaactgtgcctggcctgtctacttctatgtgactatcatgctgttataattactgtagctttgaactatattttgaaatcagatagtgtgatgtctccagctttgttcttttcactcatgacagctttggctatttaggatcttatgtggttccatataaattttagcactgttttctagttctgtgaaatttaacattggaattttgatcaggattgcattaaaactgcagattgctttggataataaaaacattttacaatattaattcttccaatccataaacacaagataactttccattatttgtatcatcttcaatttctttaatcaatgttacatagttttcaactctttggttaaagttatttctaagtacaatcatccctcggtatctgcaggatattggttccaggatctcctgtagataccaaaatccatggatgctcaagtccattatataaaatggtatagtatttgcatacaacctacacacatcctcgtgtatactttaaatcattacttagtacctaatacaacgtaaatgctatgtaaatagttgctatactgtagtttccttattgtataagaaaacagtatttttattgttgtatttttttctcaaatattttcatccaaatgttggttcaatttgcaaatgcagaaccactgatactgggagccactgcatgttttgtttttggtacctattatacatggaattgtcttcttgatttttcttttagataatttgtcattaatgtacagaaattctacggatttttgtatcttgattttatatcttacaactttactgaatttatcagttctaacaattctctggtggagtctttaggtttttctatatacaagatcatgtcatcttcaaacagggacaacaatgtcttcctttcctactgggatgccttttctttctcttgcctaattgctcttgcaaggacttccggtactgtgctgaatagaaatggcaaaagtgggcattctcgttttcttcctgatctcaaaagaaaagcttttaacttttcaacattcagtataacgttagcagtgtgtttgtcaatatggcctttattttatagaggtacattccttctatacttaattttttaaaattttgtagcacaagagaatactgaattctgtcaaatgctttttctcaattatctcaattatctattgaaatgataacatggttttggcctttgttctcctaatgttgtatatcacattttatggattcaggtctgttggataatccttgtacccttgaggtaaatcccatatgatcacagtaaatgatccttctaatacactgttgaatttagttattattttcttcagaatttctgcatctaaattaagaatacgggtctgtaattttcttttcctggagagttcttgtctggctttggtatctaggtaatgctcatctcccaaaatgagtttgaaattactccctcttcttaaatttctcataaaattatgagaacaatctgtactagttcttctttaaatgtctgctagaattcagcagtaaagtcaccaagtcttgggcttcctttggtgggagatatttttatgactgatacaatccttgtcactggactgttcacatttttcatttcatgattaagcttggacaagttgcatgtgtctaggaatttatccatttcttctatggtaatcaatttgttggcatataattgttcagtctcttatgatcctcttatttcttgtacttctctggtatcagctgcaatggttcctctttcatttctgatttaacttgagtcatctctttttttcttagtctagctaaagacttgttgcttttatcatcaaaaaacacaactctttattttttttatcttgagtcatctcttttttccttagtctagccaaataacctgtcttttgagttcagattcttttgtctgcttgctcaattctgcttttaatgctcttttgcatttttcattccatttattgcattttcagcttcagaatttgttaaaaaataatttcaatctcaaaatttctcattttgattgctgttttcctgattttgttgaattgtttatctgcattttcttgaaattcattgagcttccttaaacaattactttgaattctttgtcaggcagttcatatatctccatttctttatggttggttcaggtgccttattgtgttcctttgactggtgtcacgtttccctgactgttcttgatccctgtagtcatgtgttggcacctgcacatttgaagaagctgagacttgttccagtctttgcagagtgactttattgggtaaagcccttcaccagtcagcctgtccagagattatgcagcctgagtctaccggggctggcctggagtctgggtcagcagggtaggtcctggagccttggtacacaggtgctgctggcctggcatcctggtctactagagtgagcctgaaccttggatctgcaaggaccagtgtgaaggctgggtaggtggatgttggcctagaatttggatcacaaggggctggccaagtactgggtttggacccttgttctgcagtgatgtgaggccacaggggccgatctagagggcagggctgcagggaccaccctagcactagacaggcttagagcctagggctgtgggatccagcttggtgctggggtgggcctccaagcttggtttgtgggtattggcctgaagtttggggccatgggggcctgcctagcattgagttttactggggcgagctcaatgttagggtctaagtctggtgtacacttcccctccttcccccaggtgaacagtctctctctccatgctgggatctcagggactgagggaggtgtgacacaagtaatgtaaaactgtccttcttacccttttcaatgtgtcttttcttatctgtgtgccacattcaggtaatctctcgtctggtttcttagctcttatatttttgtgtgtagacagttgttcaaattgatggttctacaatgagatgagtgctgcaaagtgctagtctgccatcttgctgttatctagacctcaggcttttcttaaaacaactcaacactttggtctggcatcccaacctttccaatcatggccatcatccacagcatataaattcaaatactccaatgttaacatcttatgcacatgccactaatgattctgttccatcagctctgctaatatccaaccctaaaataccatgcataatcttctggctattggagaaaagtctttaaatttcaaatgtgataaagtctttaatcttaactagtcactcagtggaatgagattctcctactctgatacggtttctgatttcaggtagccagccagtcaagactctcaacttctgatccacttcttcacccattcccctcagtagcttcctaagttttcagtcttctcaaaacctctaaacaaaccttgtattccacaaaatattattaaaaaatgtttcataaaaagtttcgtggtcactaacctacagtaacatactaccttatatccactacaatgactactattgaagtacacacacacacacactctcacacaatatgtgatggcaaggatgtagagaaactggaccccttgtgcactagtggtagaaacgcaaataggtacagttgctctggaagagtatggcagtttctcaaaattttaaaaataaaattaccatatgatccaacaattccacttctgggaaaacaattcaaagcagggtctcaaaaagatatttgtacactcctgttcatagcaacattatctgtaatagctacaacatggaagcaacctgagcgctcatcaacaggtaaatggataagcaaaatgtggtatatacatacaataaaacattattcagcctgaaaaaggatgcaaattttgaaacatgctaaagatggatgaaacttgatgacactgcgaagtaaaataagccaatcataaaagggcaaaaactgtatgattgcacttatagggggtacttagagcagtcaaaattagacacaaagtagaataatggttgtcagaggctgtgaagataaggaaatgaggaattattgtttaatgggtacagagtttcagttctgcaaaacagagagttctgatcgtgactgtgcaacaatattaatatacttaataccattgagccaaatacttaaaaatggtgaaatggaaaattttacattatgtgtattttactacaattttttaaagcttaaaagacaagtcacatggttgggtcacataaatttgagaaatacattttatagtcgtttcttgcagattcacaatatataccggcatttaaataaggttccaatattttcagtaaaaaaatcttgatttttccaccctcacccacaattacaattaatatcacacatccatctttacttccttgttctaatttcattagatgggcatctttcctcttattcaaggtcaatcactatatctgcatttttctttttttatattacctgtatgagagatacacctgtatttttcattccaacccttaatacctcgaaaaactttgctttgataattactacctctattatctgaaacatctttagtcttcacaataaatcactaaagtcttacttacttcatgtcctaaatatttgtcttaaatccagaaaaatttattttgaattcctattataccactgtcattgtcaaggctctcactgactgaactaccttaccaccacacgtttctcttcaatcctttctctcttgcaaggttattaaaaatacacgtttgacaaacttactatctacctactgagcaaattctttgctgactccctaataccttctatcacatcttatcttcttcattttcctacctctcagctagtttatgatctaaaagtcctcaactgcctattgtcccctactccctatgctgcttctaactttggctcatacttctgcctggaataagccgctcatgcttctagctgcctgattcccagtcacatttcaagactgaacttagcatttcctggccactcttacttccctgccatctacactagattcctattgcatacctgggtactccagtactccttcatgttactattgtattttggataccattctacctcagtgactgaaattatttgcttctgcatctttcactcttgagtataatataaatttctgtagggtgaaaactaattattacgcatctctgtatctataacatagtacttgatgccttaaatatggtaggcgttgagactgttaaactcaactctttcctcaacctccctatttccctacaactgctaccagggaagcaaaaagactaagaatttaggcgtgtgcatttatctatctagtagtagaaacctagtaaactgttaccgaggtttagagttatctgataggaaaaaaagtaggtatgttcctatctcccatttactgctaaatgattcctttcttttaaccagaaattatttccaaataatgtgacgtaatttaaagcagtctagggcaactcaaaataagaaccacagtctcaaccaagttacacttacattcggctagcttcaatgtcgtcagactgaggttctcctgatctgtaaaatgcaattgagaaacagttagcaaaatattccatattccaaaaaaaaaggtagacatattacttaggaagacaattttgtaaacaagatttaagcactaaataaaacagttttaaaattaaagatgtcaacatgaaagaaagtggtcagatcaggtggccatacaacacatttattttaagggttggactattaaaaaactcaatgcatgttttttaaaggaaactgtaaacgctatacatagataccaacagacaagccattataagccataattattcacaaagtcaaatacgtgtaataaaacacacaactaaaaaacttcctatagccaagtattggttatccacattaacaaaggtactcactggtattcactcacagtattaaactttagattagtggctcagtaaactactccctaggcagacagactaaagcttaggccagccatgtagttttgtaaatgaagttttattgggatgcagccatactcattcatttaggtatcatctatggctgctttcacactaaaagaacagagctgaggacttgtggcagaaaccacatggcccataaagcctaaaatatttattttctggccctttaagaacaaatgtgccaaccgctaccgctactccagacaattcaaactaaaatctaataccttggtaagtttaaagacacttaaatcagatacaacattctaatgatgattatcttggttcaacaatgaaactgtttccctaaaaatacacttactgtatgtattacctgtcaaaagtgtatcacctgaggtgaagttttgcactggatagctgtgaattaacttcagttttaaacagttgccagttactttgttatttctaaatatactactgctctctcatgtagaaatatttaaaattctaagtcactaaaaagcctttcattttcatttcacgagatatgaatcagtatttccctatctattcacttttataaacagcatcagcaacaatgaatgagtcaatataatattgatttctaacacttagaaattcccaaactagataaaaaatgttttttgaggtcaaaagctaaattttcaaattggcattacaaagtcctgatttgtgaacttctcactgactttaggcttccaactttaagcaactctaacaagaatcttaaaatcagtcacacacacacacacacacacacacacgcacacacacaaacctgttttctaaatttcttagctaaaaacaaaaacaaaaacaaaaaacaacccctcacttctttatcagactctcaaaattaccctcactgcaattcattcagattccaaggacaagaatggaaaaggaaaaaaaaaaaaaaaaaagactccagcagctcaaatatttattttagatcttctttgcaatgtatttaaattttcaattttgcacaaaattacataacaactaaaaactggggcatgctggaggtggcagtgacttggctgtgacacaaatgcaaaaatttcactccaccctctcccccagggagcaagcaaatcacctatgtgacacacctggtctccaccagccttgtgggtaagtaccccaagattgcttccaaacttgtatctcccagacagaagagctaaaaattgatgataaccccatgtaccagctgactcatttttgaaagtgcgaccctccagcatcagatgtcatactgtaaggaggcagagctggcttgcaaaacaaaaaataaacctgctggcactgagggaagagaggcagattagaagttttcaaacacgtaggcagcaaaactttcaaaattaacagggaaagagaagagagggaaaaaatgaggacatgatgataggaaaataaaaatattactgcaaaaaggtaagacacaagaagaaaaacaaatctaagtcttagaagtacaatatgtaactgttacaaagttttgagatcctgaaatgggatagagtttaaatacattatcaaatgataactacatctatcttcccaatttctgttccctaagcaagagaatatgtgaactttggcatcaaaatgtttgccaccaaactgtaacatattaattactactttttacatatattaaagtaggctattaaaaaccattgataagacaagctaagtaatttaaaccaatccagtatagaagaagaaggattgaaagattattaccttaaaataaatctgtcctgggtctattaaacatagcaaagttgttctactcaaattggaaattgttttttaatcaagagaaaaatgaatatatgcagaactagcagacatttttcttgcagtaatttataatagtttctgtctgaatgaatttctactcatcctaataacagtatatttctagaatattataaataagttaccaaagtcccgaggttagaattcaaactctcaaaactatgacatatgccaggtgtggtagttcatgtctgtaatctcagcactttgggaggtcaagacataaggaccacttgagctcaggagttcaaggtcaacctgggcaacatgatgaaacctcgtctcttagccgggtgtggtggtgggtgcctttagtcccagcaacttgggaggctgaggtgggagggtcacttgagcccagaaggtcaaagttgcagtgaactgtgatcgtgccactgcactccagcctgggcgatggagtgagaccttgtcttggaaacaaacataaactatgaaatatataccacctagcaacagttcccaagcttgactttggctcctaaagagtctacttattcttttactgccaagttgctggaagtaagaatcctgtatgtgcttgtaaatgcagaacatataacctaattcaaaacatataaccaaagggaaatttttgtattaaactattgacttaggttatcctaaagtgtgtcagaataacaagtcagaaattttaaaactgaaacaataaccaaataacattggataataaaatgtaaatctcagaatgagaatcaattttaggtcttgatttgaatcgcagaaaatatgatcacaaaacacccactaatctgaatactgcagcatgagctagcaaattcaaatggtggctcacttccaataacactggtgcagcttctccatcctgcaagccactccttttacctccactgtaactctctaggagagaaaagtatactagttttattaatgttataaaaacttctagagaaatgtttagttaaaacgttcaccacataaaaggcatactttaaaatgcatattaagaaatttttaatgttttctataatgtttatagtaaaatgtttaaaaccttgaagtttttttgagaaatactttcctgtttatacatacagataggtctttgatagtggctactgatatttttaatgagaaaaaaagacactaaaatattttaaggagattaaatgaagtaggtcaactctcaggcccactattcttagcagtattcctgccaactatacattgtcttcatttttacagtatgtatttcactttacaatgacagccttttaaaggctgtaaaataattcaaaattaccttttacaagctgtggccattcggtgacatcagggtgatcacagctttgagtcactgattaaaaacaggttgtcacaccagtctagctgctaccttgatctgagcgtaggcttaataactctaataaattaaacaaacctttggttagaacactttaatatataaacccaattcattgttcaaaaaataatattcaaagcttcaaattaggtgtcaatgtaaaattcatcagaagagtaattattatagaaaagtttttaaggactattttccagcattttgtttttcttaaatgatctcttcatttgagaaaatgtaataattccttgtacttttatgtaatgttatagtttctgaagcattttggtcaatagtaccttgagtcttataacaactttggctttacctaatcaagacagataatatactaagaattaaaaaaaaaaaaaattaagcagcctccgagtgattaactgacttgcccaagattttggaactagtgttgaaggactgactaaaacccagatatactgacttcctatcaagggatggatttttttgtttgttttggcttagttttgctatactgggtttcaagatttaagtatatgtaaatgagtaaagattcagaacacagattgagatctttcaaatacggacaaattcagtcaaaagattcctaagctgatagagcaatcagtcaccaaggagggcaactgcttaatggaatagttatatacatacacataaacacacacacataaacacaaagtctagtcccactaattctgtatgtacgtaaagtcatttaacatcagtcaccgcatgttctcactcacaggtgggaactgaacaatgagaacacatggacacaggaaggggaacatcacactctggggactgttgtggggtggggggaaggggagggatagcattaggaaatatacctaatgctaaatgacgagttaatgggtgcagcacaccagcatggcacatgtatacatatgtaactaacctgcacattgtgcacatgtaccctaaaacttaaagtataataataataaaaaacatcagtcaaaaccccttaagtactgcataaaaatatattctactctttcttggccataaatctactaagatttaatttcatgaaaaagtatggcaaaagatgaaagcatatcctcctccctcaaccaaatatctttttaaccccttacatggccttagctgaacttttctgattgtcacagttcaaatttagcaggcctctttactgacactgtagttctggcaaagataccatacatctgaaatatcccagtatcaaaagatcattttgtgcaactagttctttcccctcacgattcccctatccaggccaaatctgaggcatcaactacggaaagatgaggaaattaggaggaagaaacctttcataattaacatcctcaaagcaacaatagtcaagcgtaaaaggtggttaccagtgtggattcagaacccaatataaaacagcaaggtatctgcgaataccaacggttaaaacatgaatgtttgagcccatacctatgcagctatgaacgcagggcttcaaaatccagattaggtgaggattggcctgaatatataaaaataattgcaggggattccaataaatgggatttatagtatctgtaagaaataacgcaatctcccagatactcctatcctaactatacattgcctaataagaacttagacattgctgaggtcatatgggaaacaccaccttccctaaaataaacaatgtggtcatgatacagcttccccttgggttctcaagagactaatggtatgtggaattagaagattcaaacaagtctaactttccatcttgtaaacacaaaaataataaagttaaaatatcttttaattgactaattgacctcaatgtaattaaagagctatatgtattttgaaaactagagtcaagtcctctcttccagtcccctcttttatgagatccggtgctcaaaaggctccaaggccaggctggacttatgtctctgtttggtcattcactagctgagaaatcttgggcaagttacttaacctctccgagtctcagtttccttataggtagaactaggataatagtacctattccatagagctgtcatggataaacaagctaacatctaagtatctcagaacagtgcctgacataatgtgctcacaaatggctgggcgtggtggctaacgcctgtaatcccagcactttgggaggccaaggcgggtggatcacttgaggccaggagttcgagactagcctggccaacacggtgaaaccccgtctctactaaaaatacaaaacttagccaggtgtggtggcacacgcctgtaatcccagctacctgggaggccaaggcatgagaatcacttgaacctgggagatggacgttgcagtgagtcaagaaggtgccactgcactccagcctgggcaacagagcaagactctgtctcaaaaacaacagcagcagcagcagcagcaacaacaacaacaaatgaaagctattattaatactcatagcccaaaatccaaacctgccctctcaatctttttatgcatattattttacctctcatagcacactaatctcttgtaaattttttcagcaccctacctgggtccctcatacagtcttggaagtgtagttagtgagcacctgacacaatgctttaaaaatggcaggggcccaaatttgctgaacacatctgtcattattatgacattaagatacacatgcaatacgaattccaaaaaataaaacaaaaacataccatatttcgccaaacttctgaggagctggtgaattctaaaatcaggctcttacagatttttaacctaaaatataaaacacctcactcaattctttttacataaacaactggatgaactttcaaaaaaaaaggtactaaatttcatcataaaggcaaatttattttctataattatgaacatccaaaaacgtatcaagaaacaaattactgctgttgccgggatgaggaaagcataggtaggcaggccctgtggcctgagtgctttcagcaggcaaagccatatttcccatattcatccataaagcttagtgccttctatttatttactctatcctccctccaaaagggctaaacacatatgaaaactatttgactatatccctctaatcctttcaaatacctatagcaattttgtttttaattaaattctatatgctaagcatcggctatgttaggtacaaatctgggcatctaccactttctagagtagcagccttgggccgaccctctgacccttgagtctccaatgtcaggttattgtagcagagaaaatgcgttaaaaagttatagtataatgcctacctggcacaaaacaggacttcaatatacgacgataattataatttattaaatcaaccacttaatatatatcaaaacttaactcttaaaaaaaaatcctgaagcttaaagcaagcccctaaattatcactgtaaattcttaacttgtttgtatacaatcagaacattcctcaatggaacaaaaataaagtcctttcatgtactgcattacatataaagaaagcaaatctcaaaggttaagaaacctatccagtgtcctagaggttgatggtagaaagtgaatacactgcatataaaacattttgaaataaaattaaccaacttttaaggttttagagactgactttcaaacttcagtctataatagaattacctggggaaatctaaaaatgcaactacttgggctctactcgcaaagattttcattcagtgcatgaagtaggggtaaatgaattttttttttaatttttttcagaccaacccaagaacgcagaaatgaatttgcattttaacatatacttcacatgacacacagatctcattttaagaagccctgccttccaaattatgagttaggaacacataatcatggaggaaatataccaaatctataaaaatacagaataacaaaaactgtaagcactacaaatattaggcacactcacttgccaatttaaccataagaatcctaataccagacatagttctcttactttatctcttcaacagagggctcagtctaataatcttataaataagtatagtctaataataaatgcctatgttgatctatatctacctccctaaaattttcattttattcatttctatttttccttcacctccttctaaagctgtttcaaaacttaatttcacaaactgtttttttctatcactttttattataacacccaacacttctgttctcctttgcatcatgtttatggtgtcttatatttatggataatgctacttattaaaactgtctaagttttgtccgtttacacatttcacaattaaaggactactacaacaattttcctaagtcctcctgctttagtttctccttattccagtccattctgcagttaagacttaaaaagttttaaatactgctttcaaataatacttgcaacataattccctcaactccattagctcctcagagtaccatttctttatcttctttccttttactgccaaaaagacgtgaaaaccactagctcagctgctatttttctatctactgaaatttttcttgtaaagtttccatcatttctgtatattcccagtgctttggccccttaatcctacttaatttttgtagcttttaagactgctaatgactcctcacctcctctggcttccctaatgttgtatccactcattttcttccatctctctaaaggcaataaggtcttctgctagttcatcttcctacctcatacatggcctctctccaagtttctgtcaatagccacttttcttaacctaaaccaattttctgcgcaatgtcatccattcccatagcacctctatgcttacaaacccctaactctgtatctttaagtccttatgtctggcatggtatgcctgcaactacatattaccaacggtacacatccatttggatgtctcattaacatctacattcaacgtatctaatatcaaactcaattattttcccaaagaactcactctgcctaatctcactgtcctggttaaggactaaaaaaattggtgccattcattactttctccccctcatttttatttgccctaaccactgtgtaggttgatacttgttcagccttcaaattcttcataatcattaattcaaaaactgtctactagattttgagtgcctactaggtggatgaagatgcagaggtagaaaaactagacataatttcttgccctcatgtggtgaaggaaatgggcacaaataaaaaccacaattaattatgcaataacaatgcacagttaagtgttgtgatggagagatacagggggtgttaagttgtgtactgtaataaaaagtccttagtctgaagaaaaggaaaaccattctttatgagggacaagcaagatttacaagacacactaagaaaaaccctgtgaggtaatgatggtagcactatcagtccagctgctcaaattggaagattctcagtcatattctaaagagtctctctctttcccagtatatcaaattgtttaccaattgctaccaattcatccttagaaattcccctacatttctacattctcacattattccccagtcttttttgattgcttttagttgcttccagaataaagccaaagctcccaatcacgtcagatgagattctacacaatttggtcaaaacctgccagtgcagcctcttcttacagactagaccagacttcaagagaacatgtgtatcatttgcttttatacttccagtgcttgcaaatgtttatagaataagcatcttacaaaagagaaaatttttctcttagggaactagctttcagtcctttagtaaatgcaaggttaagattcaaaccctaatttgtctgattctaaagaccacgcttattcccttgtacttgccttctaatttatactcaaaccctatgaatttccttaaaaatatctcttactccttttttcctcaaacttaccaacactgtcctactacagtgccccattatttcatctggtttcccttttgcctttatcctcaactttgccactagaattatcttcctaaaaactcaaagttacacatatcattctatattcaaaagctttaacactttctcatgccaacagaataaatttctaactccttcacattttatttgaggcccctgccatgtggccctgaccccagccatcccagcactactgcccactatatgacatcatcaccagttaccagatctagtcccatcatttgactattggctataatgtactggatatttgtgtttctgacttcaatgcttttgcttctgaggagacttcactcggaaatggtcctctatccattactaacctctatcccccacccacctatcatgccatgttaaaaactggcctcattctaaacactgtatctcacagggttatctaaactcttatacataatcaccatctccttcatgtcttattatacattcttaataccataaaataatttattaatttctccttatatttattatgttataccttacattacagctatctgtatacatttgtcagtgcctctagttgtaagctgattgatggtagggatcatctcttccatattttacttttcgtaataatggtgactatgttttcttgacaccatacctcccctctacaagaaaaaaaaaaaaaaaaaaaaggaatcaggacccatggcctttgagctagttccaaatgtgactcatagatgaacaaagataccatttcttcccaaattaacacaaatataagtaaatgccaatttaagaaacgttttttcaaagactaaatatgtaagaataaccaaaacaattgtttctaataatgttcctttctctaccagatattaaaacatattaacttaaatggaataattaaaatcggcatgcctttaaaaaactgagtatacactaaatatatgcataccttatgacttaaaaatttcactcttaagtataccaaacagaagtaaacatattcacaagaagacaatcactgaaatgtttagagcagcagcaatattcttaacagttccaaaccaaaaatgattaaatgtccgtaacagcagattaaactatggcatattcttaaaatggaatatcacttccattcttaaaatggaatatacagcgactatcataaacaattactacaaccaacaatgtgaataaatctcacaaatacattaaaagaagtcagacacaactaaatgtgcttgattctagttaaaggatgaaaacaggcaaatctaatctatgctatgagaagtcaggacagtggttacacatggaagaaaaggggtagtgacacagagcacaaggggctacgcaggagctgctgctgttttttgatctgaatgctagctaaacgggtgctcagtgtgtgaaagtgcaacaagctatacacttagaagtgtatagcttaaaacattctaaaaaaaaaaaaaaaaacctcatatggtattagcattagacaaagaggtaagcacaacaagcacaacagaaagctaatttcagagaaagatccgaaagtatctgacagttgctccttctcaaacgagaattttcagaccttggataacaggcagcagaggactataatgcatgaaaggacaaaaacaaaggaggtgagccatccactgcttggatgtctgcctggaggtaatttccaacctgcagtcaatggaggggaaatccagtgagaagacagcagttttactgagttcagaatcaagagatcagagctgagaaagctgaagtgggtaaaattgatgacaagtgccagacaagtgcttgtctgagaaggcagagaaatggcttcagaaatctgccatttgagagtccactgctgagtactaactgtacacgattaaggtaagtgactccatgaagctagtgaaagaggggcagtaagctgaaatattcccagtacttataaaggactgggagactcctaaaattctctctaacctgagtgaagagaacacggtgacactgggagcatttagtaaagactcagaaggatcatgccttaggtaggagctactaccattaaagcaaagccttctctagacaaactccaatgtagccctgaagggataaaactgaccagcaagttatttaggtggctacaaaacaaaacactctaaaagaaaacaaaatctagacacccaacaacaaaatattacaatgtccagcatccaatcttaaaaaatcattaaatatgtaaaaaacaaaaaataaaataaaataaatactaggaaaatacaacccatgaccaagagaaaaaaccaaccaacaaattcagagtgaaaaaattcaagaaatcaataagtaacctgattttcaaacagctattacaaatatgctcaagaattcaaaaaaatacatgaataaaatgaatcaaatggaatttcttgaaatataaagcgaaatatctgaaattatttaacaagggaggagaaaaaacagtaaaatagaagacaaagcaaactgaagcacagggaaataaaaagactgaaaaataatgaatatgatgttaatgacctgtggataataccaaacagtctaacatatgtgtaactggagtcccagaaaaagaggaaatgatgaaagaggagtaaaggtggtaaaaaatatatatatagaagaaacaatggcaacaatcttccaaatttaaggaaaaccataaatgtacagattcaaaaagaaaaaaaaaacaaaaccccaacaactctcagcatggtaatcattgtgcaaatatcatagaacgtacttacacaaatctagattagatggtatagcttactacagaactaggatacatggtatagcccgggtgctcctaggttataaagctgtacagcatgttactatactgaatgaatactgtaagcaactgtaacaaagtgtaagtatttatacatctaaacctagaaaaggtacagtgaaaatatggtggtataatcttaaatgactattgtcaactatgatctcgttgactgaaatgtcagcatgcggcacatgactgtataaccagacttctcatcaaaaacaaatgctgaaagaaaaacacatcaactaaccaagaaaaaagaaacatatatgtccacacagagacttctttttttacacaaatgttcattgtacctttttataatagctgggaactgaaaacagcctggaactgaaaacagcccaggtgtcccttaacagatgaagtcacaaaccaccgaaacattcaacaatatggatgaatctcaaaaacattatgttgagcaaaaagaaactttttacaacatataagtattgtatgactctacttacataaagttctgcgcaagctaaactaagatgaaaacaatctgaacaatgttaggttctaggggtggtgtggggggaaggaataactaggaagaggtgtaggttctataccctgatagaactttctggcaaaggtgtatacatttgtcacagctcatgaaatggtatatgtggtcaactgtattttccaaagatggtcacaatagaagccattccacatgctcttaacaatgtaacactgtcattttttcatcaggtggtggagtctatggcccttctccttgaatctgagtgaaattagtgagtctttcaatccaaagactacagtcatacctcaactatctacagaggactggttccaggactcccatggatcccaaaatccaaggatgcttcgaatcccttatataaaatggcatggtatttgcatataacctacatgcatcttcaaatatgttaaaccatctctagattacttataataccaaatacaatgtaatgctatgtaaacagttgttacaatgtattgtcaaagacaagctctccttgccaatccctgaccaaatgagagattcatgagcaaaataaatagttgctgatatttaaggcactaagtttggggcaatgtattacacagcaataaataactggaacagcatagtaaattctagttaaaaatactaaactactaagttttagttaacatacatgctcaagttaagggtgtggtatactaacaactgcaacttactttgaaaagcataaaaaaagacactagaagaagacaggatggatagatggacaagatagaagacaataacaaatagaacaaaatgttgtgaaattatattctacaattattttaaagtctgtgtggtttgaaaaattgtacgataaaatgaagagtgaaataaagacatttccatacaaa

SEQ ID NO: 2 - DNA, 150237 bp, Macaca mulatta
  misc_feature (64387)..(64600): n is a, c, g, or t
  misc_feature (76284)..(76747): n is a, c, g, or t
  misc_feature (134705)..(135171): n is a, c, g, or t
  misc_feature (145964)..(145983): n is a, c, g, or t
cagatgtgcagccctccaataggacaaataagactctcagagcctggctctatttggggatccctcagtgacaacagagtacccctgtgagcatgccttttctatctctcctgagagggcagtagcatgctgtcttaggagtcagtatgctctttagtatgcttagtcacccaagacttgctttaattgtagatagatacttacatataggaaagatgttcttaagtaacaaatgaaaaactttagaagattgaattaagggtcaagcaactgtgatatgtctgcaaatctcattagtgttatgctgaaagaaggaaatatggcatgcctttattaaataatgacaatggaaccacgtttcgtgctttgttatttttactgtggagtattttctaagattatgtttgcttttttttctctttcatgttttgctgagatagaaggcctggagtctgatcctccacttcagagaataggggtgagtagctaaaccattatcttttgaaattcatatgtcatgtgctttttgctaggtctttaggttgttgtgtatatcttttcagaagcttattgaaggacattttgatgatacgtccttttcctcattgagaccctcaccatgtcacctacactattgaatctatcatttctgttttaattttaactctcttctgcttttatggaaaaatgtagaatttaagagaatttttggcaatttcatattggatcaaaatttattgtagtgaaatccaggtgtaccaaaatattaacagagtttcctcatctgtttaattattggggtttcagaatagagactccatggttcataagatctttgtggtcatactacattatatttctgcttctaattgaattattaagtattgacttgaattagtctttttctcgttgttgcagcaaggtaagttatataggaaattttcttctctcgatggcatgcctgagataatcatagatataagacacctgggtggtttctagtatgcgtgtaatttttgtttcttgatctgtgtgttgagtacttgctgtgtttgcatcatgcaaatacattgagctttacaattttagtggatgcacttttctacatgtatattattcttcgatagaaagtaaaaaaaaacctcatcaaactagtcaaaatattggttaatacataaaaaagtctcaagtagattgtgtattacatggtgcttattgatcgatgccctcataatagatcaagtacgttctctctttagcataggcctttttagcaaatcgtgtcgtgagtagttactcaagtatttttattttaacacatttatgttttttctatgcatattcttaaattctcttacacttttttctctgttataaaaacatgctgaacaatctcaagtcttaaagattgcagtattgtccctacatattcatgtattttggtactcaattctttatactttctttgacagatcacttgaacatgtctcttgttttgcagagagggaattgatgggataccttcatgcttttctattctatgtgctacataattgaatatacaagcaaatatagttattaaggtttagtatgattatttccacaacacatgcaaagaagtttctcatacatcttaatagaggcccacatgcattgtacggttgagaatttggggaaatgttgatgaagttgggtaaagtataaatccaaaagtcagaacggtgaactccttgcttaaggatctcctttgagattacttagtcaatacacaactgataaatttaagtgcttttcaccttttgagctctcgacacactaaagctaaaatgtgtttcaacttttaatcctgcttccctaattttcccttttttagtttaagatcaaagagctccagccataaattactaccaagagtaaccacttcattttaagaaagcttagcaatatagaagaatataaaattatttatgacagatgtattttaaccttttccccatgctttccagaggaaatatgtttaatcatctgccctatattagggaaaaaatttctatgctaatacaagtatctatcaatcattaatctttctatataagatatattgatcataaccaattaattttattgtaaatgagctttagatttgacattttggtagtaatatatgttgtacaatctcctgaggtcctataggtcttgagatctctatgtcaaaaactatagatgtgtcagtgtttctggtgaatgtgaaggacgccacattttccttagccatttcttctgttcagaataatggttatgaacattttgctactgcaagatatccatatatttataatcagaatatgccagtttttatgcactcatgcctctgtttctgtagagcgttcctagaatgagtaatgcttgaaaattaggtccatgtggtttctttaatgagatatagtcaaatcatgaaatatttaggttaccattatttcagtaatgtattagaatgtcaaggtaaagttatctacattgtatatatacacacaacatagatataatttaaacaacacatacatttatatttatacagaagatatatatttatacaacataaaatatattttattatttaaacataaaatatattttatttaatgtagattcttttttttttagtttaagactttgaaggttaaaaaaaaatttttttattattatactttaagttctagggtacatgtgcacaacatgcaggtttgttacatatgtatacatgtgccatgttggtgtgctgcacccatcaactcgtcagcacccatcaactcatcatttacatcaggtataactcccaatgccatccctcccctctcccctccccacaataggccctggtgtgtaatgttccccttcccgtgtccaagtgatctcattgttcagtttaaaattcttttctttaagaatgttgaatattggcccccactctcttctggcttgtagagtttctgccgagagatctgctgttagtctgatgggcttccctttgtgggtaacccaacctttctctctggctgcccttaacattttttccttcatttcaactttggtgaatctgagaattatgtgtcttggagttgctcttcttcaggagtatctttgtggcattctctgcatttcctgaatttgaatgttggcctgccttgctaggttgggggagttctcctggataatatcctgcagagtgttttccaacttggttccgttctccccatcactttcaggcacaccaatcagatgtagatttggtgttttcacataatcccatatttcttggaggctttgttcatttctttttcctcttttttctctgcacttctcttctcgcttcatttcattcatttgatcttcagtcattgatactctttcttccagttgatcaagtcggttactgaagcttgtgcatttgtcacgtaattctcgtgtcatggttttcatctctatcagttcgtttgtggccttctctgcattgattattctagttttccattcttctattcttttttcaagattttttgtttctttgcgctgggtacgtagttcctcctttagctctgagaagtttgatcaaccaaagccttcttctctcaactcgtcattctccgtccagctttgatccattgctggtgatgagctgcgttcctttggagggggagatgtgctctgattttttgaatttctagcttttctgccctgcttttcccccatctttgtggttttatctgcctttggtctttgataatggtgacgtactgatggggttctggtgtgggtgtcctttctgtttgttagttttccttctaacagtcaggaccctcagctgtaggtctgttggagtttgcttgaggtccactccagaccctgtttgcctggttatcagcagcagaggctgcagaagatagaatattgctgaacagcaagtgttgctgtctgactcttgctctggaaacttcgtctcagaggtgtgcccagccgtgtgaggtgtgaggtgtaggtctgcacctagtgggggatgtctcccagttaggttactcaggggtcagggacccacttgagcatgcagtcagtctgttctcagatctgaacctctgtgctgggagacccactactctcttcaaagctgtcagacagggtcatttacatctgcagaggtttctgctgctttttgtttagctatgctctgtccccagaggtagaatctatagaggcaggcaggcctccttgagctgtggtgggctccacccagttcgagcttcccagcagctttgtttacctacttaagtctcagcaatggtttgcgcccctcccccagcctcgctgccaccttgcagttagatctcagactgctgtgcttgcaatgagggaggctctgtgggtgtgggaccctccgggctaggtgtgggatataatctcctggtgtgccgtttgctaagacccttggtaaagctcagtattagggtgggagttacctgattttccaggtgttgtgtgtctcagtttcccttggctaggaaaagggattcccttcccccttgcgcttcccaggtgagctgttgcctcaccctgcttcagctcttgctggttgaccagcaccaattgtccggcactccccagtgagatgaacccagtacctcagttgaacatgcagaaatcacccgtcttctgtgtcgctcgcactgggagctggaggctggagctgttcctgttcggccatcttgctcaggatccaggttttttcatgtagattcttaactgataaatatgtttaacattattaaaatagattaaaataggttatagttaatacaatgaaaattggcagtcctattgcaaaacgtatgccataactacagcatttatcactgacagtcataccaggatagtcttttatttccaatcacttaaacattcctaattgcaaaaaaaatttgaagactaaaattcagaagttttgaaagagccattgcctggataaattatacaggtttcagttttatttataataattatgtatatatttataaattaatacataataaattaataacctgtgataggcaatgcaaagatgacagtgagagggcaaaattgataagattgataaagttatgttaacatgaagaaattaaccaggataccatccacactataaagttagagaaatttatcaggacagttctcaaatactcttctcaattttaacaatgtaacaggaatttttaagattttggtattatgtgtgtttccttccagataatttgaacagattcatatttggtattttttaaagccatatctttgtccttagtgctggcaatgtattcttgagaatgaacaaatcagaaatatgtaaaagccataagtgagggtgtcaggttgaagtagtcaatcaattatacagaacacaaagaattttatcttgtacgatgttcacataactttacagaagtgtgctgaaagggctataaaacatggacatgattatctcattgaaaggtccaagaggtactgaaatacatgcttttattttgaaccaaccaccctataaacgttgtatggcttatttagatgagcgcccgtgtgtgtgtgtgtgtgtgtgtgtgtgtgtgtgtgtgtgtgaatttgacagggaagcaagagcatcaagtttccaatgcactctgactgtggttagaatcatgctgaaaacatggctcccccagttctggaatgagcccacagatcaagcattcccagaagacatagcaggctcaaatccctgtgtacacaatatttcatgattatcttatgtcagtagtttcaaagtatacagtttgtgtgaagacaaatccaatgtcattttttttttttttttgctagcctatatgtgtggtaaatccattatttatttacttcctgaaaattacaatcagattaagaaactgcagcaaagttggcatgatgagatagagactgaagtgtaagcttatgttaatgatgcccttggtttggataaacacatctaagagaaaactgaaaaaacacacatggcagggaaaccttgatagagtctaaatataggattgtatgtagtaatgcaatcaacagatgagcatttggcagtaatattatttttcaaatatggataaacactgcttaggagagtaaagagagacaaagttgaaagcaggtttatagtaggtgttgttttagtgttgatccctttttgctccaataatcaaagtgataaatattgaaaatcgattcatgcagcattacttgttccattctaatttttatatatgtcaacagtgccatctcccaacctgtgctgtccccttcaggagaagtgactgtgctgaagtttataaggttgacatattgccagcttcaatagtaaagctgaagtgtatactgaattcttaatgcaaataacaactctattggaaagtaacccagttatagaagtgctaatttgtcaggagctgccttaccaagatcaatgatgacgatagttatctcaggattctgaaagattgttttcagatttcaactagtctagctgaatgttccttaatagaaagagaggacttttagaattggttcaatatgatgacctcctgaattatctcacatagcccctgtgtacatgcctttcttttctctcagaaaatggcactatcataatagctttcttacgcagacttcaccttagggttttacagtaagggaggggtctggtgtttcatttattttgaactatttgttgttgattgtgtacagtgcttgagtaaaaaatggaatataggaacatctagaataaattttttaaatgatcaggtgactacaaagtgaattattagtgtcaaaatgttgggaaagttttaagagaatataggaaacttggacattacacaattacactgggaccaaattgtggggtctcattatagttagtatttatgtatttttttccaattgatttgtgtgccttttttctgcatgtttttggcagatagaatggctataacaagtaagagtatgtcaggaaataaaaataagcagaaccctattcctttaaaattcttcatttgatgggagggtcataaaataagtcttaacacatttaaagaattaaattcatgtaaaccatgttaatttaattccacaatggtatcgaattagagtaagaggaatatctcttactctcctaaatctcctaatgtttggaaatttaaattagcatttctggcctatttattggtttaaaaaaagacaaaaaaaaaggaaaattgaagtattttgaactgaataaaaataaaaatatagaatctaaaactgtatgggatactgataaaacaggatatagggagaaatttatagcactgaaatgcctatattagaaaagaaaacaggttttaaatcagtaaatttgtagtttaccttaagaaacttagaaaagaacaaattaacccagagttaagtaaaataaaagcattaataaaggtaagagcagaaatcaatgaaatataaaacaacaaaacacagagaaaatttgagaaaattaaaaaatagcccagtgagaagatattgataaaacttgtaaccagaccaatttaagaaaaaaagtcaaaacacaaataccaatatttgaaaatgtaagagggtaaatcattacagattctatgaatactaaaatgacaataaggaaaaattatttaaaaggggcatgtaagccaggcatggtggcttacccctgtaatcccagcactttggcaggctgaggtgggaggattgctagagctcaggcatttgagaccagtctgggcaacatgttgaaaccttgtctacacaaaaagtacaaaaattagctgggtgtggtgttgcatgcctgtaatcccagtcacttgggaggctgagatgagaggatcacttgagcccagaatgttgaggctgcagtgagccatatttgcaccactgccctccagcctgggtgacaaagcaagaccctacgtcaagaaaaaaaaatgtatgccaacatttttcaataacttaaatgaaatggagaaattccttgaaagacacaaactacaaaaactcagtgaagaagtaaataacctgaatagccctgtatcaagtaaattgaatttgtaattaaaagtcttccaacagagaaaacttcaggcacatctagcttcatatgaaatgaaaaaaaaaaaaaatgctaatcctctacaacattccagaacatttagaagaagggaatatttcccaacttattctatttggacagcaatacccaggtaagaaaaaaaggcacagaaatttaaaaagaagaatatacattattcctcatgaacataaatgcaaagaaatctaatcaaaattttagcagatgaaatgtagaaatactttatgaccaagtgagggttacccaaggaatttaaggttggttttatatgtaaagatcaaccagtgtaggaagatcacttctggaaagtcagagtaagagcctccaaaaatctactcctccataaaaccaataagagccttgacggaaatagtcgaaattaattttctaaaactttggaaattaaccaaaggcttacaaaattccaaagaacatttatgcaagaaaaatggctgaatcagtaagaacagccagctttgtggcattttaatatgcctccttcccatgcttttctccctagtactgtagtagtcttaaaaattagcagcatagcaaccactggagaagaagaaaggtttggaaatttcctaaaaagttccgtccccatataattatcactatttgacctctaaagcccaatctatatgatttatattcatttggactgactcagtgctcactaagtaaggaaatctcaatttcaaggtattggtcaaaaagaatccatggcaattgttgactatcacaactgcctgcagtgttggtaactgaattgggataaacaagaagctgatcaaaaactgaaaactaaaatcttgggaatgagatgtctagaggctgtttcaaaaagctctgacacattcctttttatctagaaagccacatgcaggctgggcgtggtggctcacacctgtagtcccagcactttgggaggctgaggcatgcggatcatgaggttaggagtttgaggccagcctgaccaatgtggtgaaaccccatctctactaaaaatacaaaaagtagccaggtgtggtggcgcgcatctgtaaccccagctactcaggaggctgaggcaggagaatcgcttgaacccgggaggcggaggttacagtgagccaagatcacgccactgccctccagcctgggcgacagagcaaggctctgtctcaaaaaaaaaaaaaaaaagaaaagaaaaaagaataaaaaaagaaagccacatgcatgtaattgtttacctctggctttccttttatgctctgggcaagttaaggaagagttgtgaactacctaagtgctgaatgggaaccataacacacacacacacacacacacacacacacacacacacacagcaccttaggaaagggtgagaagcatgttagttagaagcattaaaggaaatctctttctagtcattatctgtgcactataactgagcagagacttcagtatccacatactacagggcatataaactttacagaattagtccgggaaaatcatgtgaaaaaaaaaacagcaacaaaaaaaactctgggaaaggggagaatatgatttgaagagtcgccacattatacataatatgtctattgttcaacaaaaaagtacgagacatgcaaagaaacagaaaaatatggcacaaataggataagatgaagtcaatgaaattatccttaaggaagaccagatgttgatcttagtagacagacattgaaccagctattaaaaatacgtacatagaactaaagaaaaacatgtcgaaagggttaaagaaaggtataaaaatactgtcttaccaaatatagactaccaataaagagagagaaattatgagaaaagacaacatgaaaaaatgtaaagcaaaaaaattagacagttgaaacaagagggcctctatttgcagatttgagcaggcagaagaaagaatcagtgaacttgaagatacgtcaattgagattatccagtctgagcaacagaggtgggaaaaaatgaagaaaactgagtaacaaagaaccgtagaacagcgtctctcatgccagtggatgcataaactggagccctagaaggatgaaaaaaggagaaggaaagataacttcccaaattttatgaaaaacatgaatttatatacccgagatgaccaataaaatccaagtaagatactctcaaagagatcatcacctagccacatcacagtcaacatgtcaaaagacaaacaaggagagaattcttgaagatagtaagaaaaaaattattcataacatacacaccatcctcaataagtctgacaattgacttcttaccataaaccatgcaggctgaaaaggcaatgtacataacccaagtgatgaaataaaaactttcaaccaataattctagattcaacaaaactattgttcaaaaagaagaaatgaagacattcctaaacaaaatctcagagaaatgttctctataagacttgtcctaatagaaatgctaaaggaactccttcactctgaaatagaaaggcactggagagtaaatcaaatccacgagaagaaataaagagaaccagtaaaactacatgtgtaagtttaaaacaaagtataaatttattttgtttataacatttgtctttttcctatttgactgaaaacataatctcaattataaatttgtgttgatggcattatataaagatgtaattttgggtaatagcaccaaaatgtcagaataggagttttctgtaattgttttcccacataagtatcaattttgacaaccattcatgagcaagagtaccttgtgggagttcaggagttgacagtaaaagttcagcacaccagtggagtaaaaaaatctaagaatagattcattggaaagggtataaacagtttcactttacctgcatcaccctccccaaaaagtggcacagctcagtaacaagagcctgttatttcttccacaggggaaaacaagagtataataaatgagtatccagtttctcaagacatacaggcccctgcccaagagatccactttattttcatctcacccagaatactgaggtgatcagcaaggtggagtggttgggagagggtaaagcaggaaagagagatgaggactcacagcaacccacacttgaaactgccatagatcctaccagttgcttcatggactccatcaggagcccacctgtaagccacttgggatgcaaaactcccatcttgtcaacaaaaccccagatgctccaaatgcctcccccactctttggctccccaagcacactcctgtgaaaagcagcgagaatctgcagatggcttgcaagcactgttgacagctggctgcactctgcagaactggaagaaagctcacaaacacgacaatttcaggacaccaccctaaaaaaatgagacttcagcacctggcctgcctttatgcaacctggagaaggtgatatggtttggctgtgtgtccccacccaaatctcatgtcaaattgtaattcccacttgtcagaggaggggcctggtgggaggtgattgaatcatgggggtggacttccctcttgctgttcttgtgataaagttctcatgagatccagttgtttgaaagtgtgtagcatatcccccttcattctctttcactccaccttggtaagacatgcttgctactcctttgccttctgccatgattttaagtttcctgaggcctcccaaccatgcttcctgtgcagcctgcagaactgaactgtgagccaattaaacttcttttcttcataaattatccagtcttaggtagttctttatagcagtgtgagaatggactaatgcagaaggcatacaaccttaagaatctgcccccttgagggaacaagatgtgtggagcaggttcatccatagacaatgtctgagagaacctcaaaatccctagcctgactaactgatgaaaatgtttctctcctaaggccagtcagtaaagaccagagggggtgactctttctttaaatgcaaaggcagcagtacagtaattcaagaaacatgaaaaattttaaaaaatgacaccaccagaagaacacaatcattttccaataaccaactccccaaaaatggagatgttcaaattggtttataacaaattcaaaacaattatattaaggaagctcagcaaactaaaaggaacaccaatagactactctgtgaaatcaggaaaacaattcatgaacaaaactagaaattcaaaaaagagaaaaattatcttaaaagaaaacccagaaattatggagctaaagaatacaatgcatgaaatgaaggagcgtatacaacagcaacgttgatcaagcagaagaaaaaaatctgtgaacctgaagactggctatttgaaagtattcatcagaggattaaaaaaaaaagaatgaaaagaaataaagcctacaggatgtataaaacatcatcaagagaactaatatagagattattggagtcataaaggagaagagagaaaagggcagaaaacttatttaagaaataatggctgaaaactctccaaatctaggaaaagatatgagcattcaggtatatgaagctcaaatatccccatacaggatacattccaaaaagacttcaccaaaacacattataatcaaactgtcaaaagcaaaatcaagacaacgaataaaccaatgcaaccaccaatcactaagagggagacaggattcttatgttgtgattattatttacatataatttcagtaagtgttattagaaaatttataatgtttttaaaaaagaaatttgaaagcactgaaagaaaagagactcatcacatacagggaacccttttaagtctatcaacagatttctcagtagaaaccttacaaaataggagacagtgggatgaactattcaattgctacaaggaaaaaaatgccaaccaatgctttacctagcaaatctgttcctcagaaatgaaggagagataagaactttcctagacaaacaagaggcagttgttagatgaaaaagaggcagttcatcaccactagacctgccttacaagacatactaaggagagttcttcaagctgaaatgatatggcactagttagtaatatgaaatgataaacctcactggtaaaggaaagtacaaagtcaaatttagaacactttgatactataatgatggtgtataaataattttactatactatgaaggttaaaagacaaaagtattaaaaaaaaaaaaacatagctacaatagcttgtcaatgcatactacagtataaaaagatgtaaattagaacattaaaaacatagcatgcaagggtagggaagtaaaagtgtagttttcatatgtaatcaaatttaatttgttatcagcttaaaataaattgttatacctataagatgttttatgtaagtgtcatggtaactataaagcaaaaacctctagtagatatacaaaagaaaaagagaaaggaatcaaaacactacagaaaatcatcaaattacaaaggaagacagtaagggaggaacaaagtaagtaaaaagagcaagaaaaaatttaacatgatgaaaatagtaagtccttacctgtccataatcactttaaatgtaaacggattgaattttccaaacaaaaacagaatggacaaatggattttagaaacaacaacaacaataaacaccacacacacacacacacacacacacacacacacacacacacacacacacacacacacacacacacccagacccaactatgtgctgcctacaagagatttacttcacattaaggacacatacaggctgaaatgaaaaaaatagaaaaagatactgcatgcagatagaaaccaaaagagagcagaggcatctatacatatagcatacagaaaagattttaagttaaaaactatatcaaaaggctaaggtcaaaatcgtgaagcagttaattgttccagaagacataacaattgtaaatgtttattcacccaacgttgaagcacctaaatatataaggcaaatattaatacatataaaaggagaaatatacagcaatacattaatagtagtgaacttcagtatctccctttcaaaaatgaatagataatccagacataaaatcaataaggaaacatttaacttaaacttcactttagaccaaatggatctaacagacatatagtgaacgtttcatccaacagtggcagaattcacattcttctcaagcacacatagaacattctccaggatagattatatgttagatcacaaaataatattacaaaatttaataaagctgaaatactatcaattatttttcaccacaatagcataacactagaaatcaataataagaagaaaactggaaatttacaaatatatagaattaacatattcctgaacgaccaatgggtcaaagaaaaaaatcaaaataattttgtgacagcaaagtagaaacacaacataccaaaacatacaggacacagcaaaagcagttctatgaggtaagcttatattaataaacacatttttaaaaagattttaaataaacaacattacacctcaaggaactacaaggaaggaaaaaaaaaacaagccccatgttatcaaagggaaggaaataacaaaactcagacagaaagaaatgaaacatagactagaaaaacaatagagaatattaacaaaacttatagttttttaaaaaaattaaatcaacaaacttttagctagactaaaaaagagaagactcaaaaaatgaaagaggagacattacaactgataccacaggcaatacaaattaagagaaaactatatgccaacaaattagttaacttgcagtgggtaaatccctagaaacatacaacctacaaaaactgaatcatgaagaagtggaatatctgaacagatcaataatgagtaagggaattgaatcaatattcaaaaatctcacaaaaagaaaagctcaggatcagatgacttcactggtgaagactaccaaccatttaaaaaagaattaataccactctttcttaaactcttccaaaaacattgaagaggagaaaacactttcaaattcattataagaggccagttttaccttgatatcaaggatttaaagagaacactttgagaaatgaaaattacaggccaaaaaccctgataaatatagatgcaaaaatgttcagcaaaatactagcaaacctaattcagcaacacattataatggcatacatcatgatcaagtgagattcatgcctgggatgcaggatggttcaatataatcaaatcaacaaatgttacactgttttaacaggatgaaggataaaaatcatatgatcatctcaatagatttagaaaagcatttgacaatattcaacatcctttcaggactaaaaaccctcaataaatcaggtatagaaagaatgtgcctcaacacagtaaaagccacatatgacaaacctggaggtaatatactcagtggtgaaaagtaaaaagctttgaccctaagatcagaacaaaaacaaggatgcccaatctcaccacttatatgtaacatagtagttgaaattctagccacaccaattagggaagaaaaaaggcacccaagttggaaagaacgaagttaaattgtctctgtagatgacaagatcttatatgagaaaacactaaagactccaccaaaacgctgttttagttagagcttaaaaaaagaattcactaaagttgcaggatacaaaatcaatgtacaatatcaagttgcatttctaaacaccaaaaacaagttatccaaaaaattaagaaaacaatcctatttgtgatatcatagaaaatactaaagaataccaaagaaactgaaaataaatggaaataaatggaaagataacctatgttcatcagatgaattaatactgttaaaatgttcatgctacccaaagcaacttacagattaagtgcaattcctactaaaattccaatgacatttttcacagaaatagaaaacacagtcctaaagtttgcatggaactgcaaaagactcaatgaagcaattttgagcaagaatagcaaagctggagacatcacaccacctaacttcaaagtttattaatcaaaacagcatggcataaaaacagacagaaagaccaatggaacagaatagagagcccagaaataaactcacatttatagagtcaactaacattcaacaaagcagccaagagtacacaatggggaaagtatagtctctacaataaatggcactgggaagactgaatatccaaatgcaaaagaatgaaattacacccttatcttacaccatacacacaaatcaaatcaaaattgataaagacttaaatataatacctgaaaccataaaatctttaggggaaaactcattgacattggtcttggcaatgatttttttgatatgacaccagaagcacaggcaataagtgggaccctgacaaactaaaatgtttctgcacagcaaaggaaacaatcaatcatcagaactaaaaggcagtttatgaaatgggagaaaatgtttgcaaaccacatatctgataaagggttaatatccaaaaatatataaggaatgtataaaattcaacagaaacaaacaaataatccaattttaaaataggtgaagaacctgaatagacatttttttcaaagaagacttacaaataggcaacaggcatatgaaaaaatgcttgacatcactaatcatcagggaaatgcaaatgaaagctccagtgaaataccacctgtaactattaggatggctattatcaaaaactcaaaagaaaacaagctgggggaatgtagagaaaagggaaaagaaggcccttatacactgttggtgtgaatttaaactggaatagccattatggaaaacagcatggaggttcctcaaaaaattaaaaatagaactactatatgatccagcaatttcactattgagcatatatccaaatgaattcaaatgactgtcttgaagaggtatttgcacactcatatttatttcagcattattcccaatagccccgatatggaatcaacctaagtgttcatcagtagataattagataaagacaacctggtatatagacacagtggaatctatttagcattcacaaagaaggaaatccaacctttaaaatcctttaaaagttaaactcataaaaacagagaggagaatggtggtttccagaaactggagggtcagggaatggggagatgttggtcaaaaggtacaaactttcagttataaaatgaataagttctagagatctagtgtacaacagcattactataattaataataatattttgtatacttgaaatttgttaaaagagtaaatatcaatattctcaaatacacacacaaaaatagaactatctgaaggaactgatatgttaattatcttgattatagaaatcatttcatgatgtataatgaatatcaaaacataatagtgtacatcttaagtatatacaattttgatttgttaatcatacttcaatgaagctagaaaaaaatatgtaatttttaagacagtaataatataaattaagggtgagggaactgacttatgttggagcaaagtttttgtaaactaatcagtatccattcaagctagattattttaaattgttaatttaattgtaatactaaggcaaccactaaaaagggctttaaaaaatacagtacttgaggctgggcacagtggcttatgcctgtaatctcagcactttaggagacctaggtgggtggatcacaaggtcaggagtttgagaccagcctgatcaacacggtgaaaccctgtctctactaagaatacaaaaattagccgggagtggtggcgggcacctgtaatcccagctactcaggaggctgacgcaggagaatcacttgaactcgggaggtggaggttgtagtgagccgagatcacaccactgcactccagcctgggtgacagagcgagactccatctcaaaaaaaaaaaaaaaaaaaaagctaatttcattagctatatgaaattctgagagacgaaactgaagtctccaactataattgtggatttgtctatttctcctatcagttctatcagtttttgcatcacatatttgaggctctgttgtttggtgcatacacaactggaataatcgtgccttcctggtggcttgattattttatgattatatagagcctatctttgtggtatttttatttactcttaaatctactttgtgttatattaatatacccattctttttttaaaaaaattgtttgcaagatacatcttttccattcttttaatctcaacctacctgtgccattgaattcgaagtgagttttcacatagagaacatactattgaatcatcgttttaaaaatttcatttgccaatcttctatatattgaggtaaaattcacataaaatttatcattttaaggtgtacaatacagtgacatttagtaatacacgttatgcaatattaactctacctgattactaagtgttttcatcatccaaagaaggaaactttatactcattaagcagttaattcccattccttctccctgccacgggcaaccacaaacctacttttctatctctatgaatttacgtattacggatattttgtataaattgaattatacaataagtgacctttatgtttggctttgttcacttagcatactgtgttttgatattcaactatgttgtagtatgtctccgttttatctgaataactcagttctttttgttgtatacctaaaagttgattcgtaggttgtaataataattctatgtttagtttattgaatagctgccaaagtttttccatagtggctctgtcattttaaaatcccaccagcaatggatgagagttccagtatctccacatccttaccaatatttattattttatatttttacgattatagtctttctagtggatatgcaatggtatctcattgtgtttttggtttgcctttccctaatgactaacaatgttgagcatcttataatatacttgttagctatttgtgtttagagaaatttctattcaagtgccttgcccattttaaaaactgagttatcttgtcgacttatgagttctttaatacagtaaactcttatcagatatgacttataagtattttatcccattctgtaggttaccttttcacttttgtgatagtccattatgcacaaaggttttgatttttgataaatccaatttatctgcttttgttgttgtttttgttggtggtgcttttgcaaaacccagtgtcatgaggtttttctcgttatctttggagaattttatagtttgggtttatacatgtagattattgatctaatttccattcatttgtgtgtatgctctgaggtaggggtccaaattcaatttttgcattgaattgaaaattcatatttcaatttcatatttcaactgcatattcagttgctgcagcacgatttgttgaagagatcattcctttccacggggaatgatctgcgactcttatcagaaatcaattgatcatagatgtatgggattatttcggactttagatcttgttccatgaatatgcctatttttatgccagcaccgcaatattttcattactatagctttatcatacattttgaaatcaggaagtatgtatcctccaagtgtgactttcatttgctagactgttttgactatttggggtctttgcaattccatatggatttcagaattgacttttcatttaaaaaaaatggtagttgagattttcataggaattatattgaatctacagatccctttgggtagtattgccatcttaacaatattgtattccagcccatgaacatggatgtattgccatttgtatctttgttcttttctttcagcaacatttagtatatgacacttgtaactccttggttaaatttattcctaggcattttatcctttctgatgctgtgtaaatggcattattttattgatttctcttttacattgcttgttgtaggtgtatagaaatacaactgattattgtgcttttattggattatctgcaactttgctgataatttattattagcaacatttatttattagctctagtaggttttttctttttctttagagttgtctatatatgttgctctgtggataattttacttcttgatctccgatatggatacctttatttctttttcttacctaattgctgtagctagaattttcagtataaagtatgacagaagttgttcacagctctccttgtcttctctctgatcttaggggtatagctttcagtctttcaccattaagcacagtgttagctgtggggttttcttagatgctttttaatatattaaggatgtactctgctatttctaattggttgtttttattataaaatggtgttagattttgtgactttatgttcttcataattgagattatcatgtggtcttcttttcattcgattaatgtggtatattatatgattttcatatgctgatttacctttacatttttggggtaaaccccattgtgtacacaggttttttgagggtctgctaattttcttcactcttttctctccctgagacggagtaatgttaactgacttatctttaagtttactattttttcttctgctgctcaaatctgcttgaacctatatagtgaagtttttattttctcattgaacttttcagcttcaaaatttctttttggttactttttataatatctgtttctttacagatattctctatttggaaagacatttttctcctggttttctttacttatttgtctgtatttttttaaagtctttgagcatatttgaggcagttgatttaagtatttgtgtaccaagtccattgcctgagcttttgcatagagattttctattaatttcttttttttttttctgtgaacaggcctcatttttttttctagaaaattggacattttgagtattataacaacatggctattttagaaataactctcctccctccttaggttttgtttctgcttgttgcatgttgctgttgtttgctcattagtgattttttctaaagtattttgaaaagtctgttcttgatcatgtgggtccattgaattctgtgttctgttaatttcatggtcagctagtgttttgaaagtttcctcaagtgcgtacagccaataagagaaaaagaaaagaaaaacagaaaaagagaggaaaaaaggaagagggaaagagattttaaaaaataatgttggccgggcgcggtggttcagacctgtaatcccagcactttgggaggccaaggcaggctgatcacctaaggtcgggagttcaggaccagcctggccaacatggagaaaccctctctctactaaaaatacaaaattagctggtgtggtggcatgtgcctgtaatcctagctactcgagaggctgaggtaggagaatcgcttgaacccaggaggcagaggttgcagtgagccgagatcgcgccattgcactcgagcctaggcaacaagagcaaaactgtctcaaatacatacataaataaataataataataataatgtctgctgattggctctgtttgggccctcattcaatgcctagtcaggccatttacaactctcttaacttctactacttgcttgtgtactgactaaaggccagctataggtgaaagcttaacctcatctcagatcttataggtgaaagcttaacatcatctcagatctttttggaccatgaatcctaccctgggtatgcacatgatcttcttaatttcccagtagatgcaagagttttaataaattttaaaagtccttattccctcatgtatctccttttccgaccttttcagtctgtttattgttcatctgaactgacatcctttgccccaggctgctgtggcaaaaacttttacctttaaatgctttcaccacaagccacctgggaagccgccccagacctgggactgctctgaccctgaggaaacaaagacaagaccttgcacagccaggcagccataagacaagtccacacccaaaccccagttctttcagaagaaggtctgcgttggattctctggccctagtaaccagcaaaatactttgtcaagtatttttatcagtctgtggttatcttgtctttctcagagcagtttttaattttaataaaatccaatttgtcaattacttatctcatgtgactctggtgttacatctaaaatgttatcaccatacttgaggtcacctaggttttctctaggaatcgtatagttttgcgttttatatttggtgtatgacacattttaagttaacttttgtgaggttgtgaggtctgtacctagattcattttgttttgcatgttacttcaatattcataagaaacattggtctataatcttctttcttatagtatcttagccttgctttagtttttgggcaatgctggcctcactgaataaattcaaagtattccctcttcttcaattatttggaaaagtttgagaaagactagtgttaactgttttctaaatttttggtagaatttaccagtgaaccaactggtcctaggcttttctctagtaggtggttttgattatgctttcagtcgctttacaagttatatatctatacagatttttataattcagtcttggtaggttgtgggtatttaggaatctgaccacttcatctaagttatccaattagttggcatacaattgtttatagttctataaataatcatttttatttctgcaaaattggtaatatcccagtttccattttttgtttcattgaatcttttttcttagctcatctagctaaatgtttgccaattttgttgatcttttggaagaaccaacctttgatttattaattttctctattcttttttctgttctttatattatttatttccacacgaatctttactattttcttcattctgctgccctttaatgtttttttttaattttttatttttaaggtggaaatttaggttgagaaatttttttaaatgaaagcattagagctatacattttccttctggtgttcctttcacttacctgccataaattttgataagttgagtttttgtttgtcttggggtattttctaatttctcttctaatttctttcttgacccattggctatttaaatgtatttaattttttacatattgtggatttcccagttttccttctgttattgatatctagttttattccattgtgatcacagaagatattttgtataatcgcagtctattaacatttattaagcctgtgtcgtggcctaacagaggatctatgttggagaatgttccaagtgcaattgagaatactattctggtgctattaggtgaaatattctctatacgtctgttaagtccaattcatctatagtgttgaagttttctgctcctcattgattttctatcttattattctatccattattaaaagtggagtagtaaagtctcttaactattattgtagaactctctgtttttcaagtcccagctctgtttgctgcataagtgtttacaattgttgtatctttttggcaaattgaccagtttcataaacgtaaaatgtacttcttactgtcttctaacagttttttttttctttttacataaagcctatcttttctgatcttagattcccttacactccaccccagctcacttttggttacatttacataatatatcttttccatcctttcattttcaacctgtttgtgtctttatatctaaagtgagtgtcttatagacagcataaactatgtcatttaaaaaaatccattttgcttatttctgccttttgactggggagtttaatccatttgcatttaaagtaatcactgatcatgaaatactttcagtattttgttaaagttttatgtatgtcttataactcttttgctcttcatttccttcaatattgcctttgtgtctagcttatccttttgtgtcacactttgatccccttctcatttctttttgtatattttctttgtggttaccacgaggacaatgtatcaacttttaaagttattacaattttattgtttaaaatctctcccattcagggattttagaaaggttaaataataatgtaaatgagatatctagaacaatataagtattcaggaattagctcaattccaatcctttctccacctccacctctttctctgtgagattatagaaaagatgacaaaaaggatgttttctgagccctttaattgttgagaatgatctttgagaaaaagaaaaaaaatgaaagcattaggattgtacaacagcctggaagtataattaagtgtaaattaaatagataaaagttataagcagaggaaagtatagtagaactcagtatttaaaagaatcaatgtgaaaactatatacatttatataaaataaaaccaccagacaaatctgatatccttaggatttttctttctttcatgtgatttctaattgatacatatgacactaaaccattgacctgagctgtaagagaaactggaaattgttctgttatcttttgtaggatttctagaactttttgctctcagacttaaatgccaatggattcctacttattgtttactgcttttggacttacatatgatttcattctttctcatctcttatccttacaatgtaatttgaactgatgccaatttaagttcaattgcatacaaaaactctattcctatgcagctctgccccatctaatttatgttattgatgtcacaaattacatctttgtacatagtttacatattaacatggatttataaatttttatgtatttgtttttaaaatcctgtagaaaacaaaaagtcaacacatcaaaattaaaataatactggtttttatatttgtctgtgtgcttacctttatcaatgttctttacatctttatatgggtttgagttactgtcttgtgtcctttaattccaacctaaagaactccctttagcatttctggtagggcaggtctagcagtaatgaactctctgagtttttatttaagaatgtcttaatttctagctcctgttcaaagtaaagttttctgtatatacaattctctgtccattgatttttgttcattttcctttcagctcttttaaatatattttcccactttcttctgccttccaaagtttctattaacaaaattcagcttataatcttattgaagatctcatgtacatgagtggcttctctcttgctgttttcaagattctatgactttggtttttgatagtttaaatataatgtgtcttattgtgggtctttttggatatatcctagagtttcttgatcttcttagattggtatatccatgtattttaagacgtttgagtagttttcagccattatttcttcaaacaatctctcttctttggggacttccattttgcccatattggttcttttgatggcgtggcaccagtcccctagactctgttcacttttttccagtcttttatttctaatcctcagactcaatagcttcacgtgtcctgtattcaagtttgctgattcttacttcttccagctcaaatctgctgttgaaccctcccttgtaacatttttaattccatttttgtatttttcaagttaagtatttttattaggttcctctttataatttctctttgttgatattctcattttatcacacacaatttgtctgatttccattagtttttttctttgttttcctttagctctttgaacatatttaagacctttttaaagtctttatccaagttctatttctgtgcttctgtggagatattttctgccagtttatgttcttcttttccatgggccatgttttcctgtttctttgtatactttctaattttgggttgaaaactgagcatttgaaaatagagccaacttcccagtttccacagcgagtctttatgccacagtatgctttcactgattaattaggtatatctaagcttagggagcagctgagtcaaaagtttaaggtcttctcaggtcttttctgaatatacatgtttcctatgcctgtgtgaaacgttctcaatttccctatataaacagcttttttttttttttttttttttttgagacggggtcccgctctgtcacccaggctggagtgcagtcatctcggctcactgcatcctccacctcccgggttcaagcgattctcctatacagatgtgtgccaccacatctggctaatttttgtatttttagtagagacggggttttgccgtgttggccaggctggtcttgaacgcctgacctcaggaggattacaggcttgagccacagcgcccagcctaaacagctacttttgaatgccttaatttcctgaatagtctcaacccagtttctccttgaggtcttaggtggtccattgtgtgtctccacccatagtcgcttgccccaggcatctgtgggtctgtggtaccactgcagctttcaccacccgtagctgccactttttcccatctgagatcccagttaggtgagagaggtcattccttcacgcagccccttgacaggttagaacatttcaaataaggtctgttctgctcctctggttgaagggagagaactggaaaccagtttcccaccttctacaaaccaagatctcatggtgccacgggagtggcaggacaagtgcaagtgaaaatgccatacaattttctaccattttgaacgcgggtttttcttcattgggcatttgcttggttgctgtaggcttttcagttttccagagctcacacaagattactttagctggttttttgttctttcctgatgcttccctggcagaataagggttggaatttccaccattttgctgattcataactctgtagtcagttttaaatatactgatacttgagtttgttttatggcccagaatgtggtcttggtaaatatttcatgtatactcagaaagaatgtgtattctgatgttgttacctgggctattctataaatgttacttaaggtggttaataatgttgctcaagttttctatagtcttgctgattttcggtacattcattccaccaatgactaaaacaggtgtatcaataaaatctgttccatcaggttttgcttcaggtattttgagggtctgttattaggtgcataaacaagatggttatgtcctattcttaaattagcctctttatcattatgaagttaacttttttgtttgttttttgagacagagtctcgctctgttgcccaggctggagtgcagtggcgcaatctcggctcaatgtaacctccgcctcctggtggttcaagcaattctttgcctcagcctcctaagtagctggggttacaggtgcctgccaccatgcccggctaatttttttgtatttttagtagagatggggtttcaccatcttggcaaggctggtcttgaactcctgaactcttgatccacccacctcggactcccaaagtggtgggattacaggcgtgagccgccgtgcccagcctgaaataaacttcttagcccttgctaatgttctttgctctgaagcatgctttgctggtattaatatagtcattcctgctttctttgattcatgttcgcagggtatatctgtttccattcttttacttttaacctattgtctttatatttaaagtgcatttcttgtaagtataattggtttctcaaaatccagtctgacattctctgccttttacatgtcatttttatatgatttgtgtaaatatgattattattacagctaaattgaagtctgtcatcttgctatttggtttctatttatcccatttttcccttttttttttttttttttttttttgcttttcttgagattgagcattgtattagttttctagggttgctgtaggaaagtgacataaactggatggcttaaaacaacagaaatttattgtttcagtttggaggctagtcatctgaaaccaaggtgtcatcagggccatattctctctgaaacctgtaaggaagaattctttcctgcctgttctagcttctagcattttccagcaattcttggcattctgttgcttgtagatgcatccctccaatctctgcctctatcataacataaccatctcctccctttgtctgtctgttcttctcatcttataagaacattaattgctgaactggggcccagcatagattaggcctaatctcatcttgaataggttatatctgaaaaattcttttttcaaataagatcacatttataggtactaagagttagaacctcaatatatcctttggcggggaccaaactcaacccataaaaagtattttatatgattccattttatctcctcgttaggttattaactatatctatatctatctatctatctatctatctttttttttttttttaatttcagatggaattttgctcttgtagcccaggctggagtgcaatggcacgatcttggttcactgaaacctctgcctcccaggtttaagtgattgtcctgcctcagcctcccgagtagctgggattacaggcatgggccaccgcgcctggctactttttgtatttttagtagaaacagcgtttcaccatgttggctagggcaggtctcaaattcctgacctcaggtgatccacccacctcagcctcccaaagtgctgagagccgccacacccagccttataattcttttttaattcagtggttgctttagggtttatagtatacatctttatcacagtctagcgccaagtgatatacccctttatgtatagtacacggcccttacaatagtgcatttccatttttcctctctggcatttaggccattgcacacacataaactcaattgatccctttgtgtagatccgtatttccacctgctatattttgcttctgtctgaaatctatgtatgatttcttttatgactattttgagcaatttggttatgttcatttgcctatttttcttatacacttttagctcatcaatcttaactctgtgagtttatagtttttaaaaacaaatttgaaattatttggctattatttcctcaaatacttttttctgccacccctgctttccctttccttagggatctccgatttccacctatattagtctgattgaagttgttccacatctcttttgaaaatctctggaaaatcttttatcattgggataatctgtatttgtacatcttcaagtacattaatgtttaatctgctgttaatcccatgcaatggattcttcatctcaggtattgccgttgtaatctctagaagttccattgaagtcttacttgatgaaaaatgtggataaaaacaagtggtggtaaagatatggagaaatcagaatccgcacacactgatgatgggaatgtaaaatggtcaaggcaatttggaaagcagtctggcagtttctcaaaaggctaaacgtagttaccatatgacatagcaattattcacctaggtatatactccagagaaataaaaccttttccacaccaaaacttgaacattacttaatgttcattaggggtttaaaattttgtacagtatttttatttaaagtagagatgggggtctcactatgttgcacaggctggtctggaactcctgggattaagcgttgggacctgccttggtcctgttttctccgctggaagagaataaaactttgtacgcttggaccaacaactcccgattccctcctttaccaccatgccccatagcctctagtaacacttactgtccacttccatgaattcaactttttaaagattccacatataggtgagatcacgcaatatttttctgtgcctggcttatttcagttagcataatgtcctccagattcataagtgttatctcaaacgacaggttttaccctcctttaaaggctgactagtgctccattgtgtgtatgtatcacattttctttatccatttatctgttgatgggcacttagattatttcaatgtcttggctactgtgagtaatgcttcaataaatatgggaatgaggatatcccttcaacatattgatttctgttcttttggataatactcagaagtgagattactggatcatatggctgttctattttttttgagaaacctccatactgtttttcctaacggctgtactaatttacattcccactaacaatgcatgagtttgcttttctgtacatcctccccaacactcgtcatctttcatctttttgataaaagccattatataataggtgtgaagtgacatctcactgtggttttgatttgcatttctctaataattagtgtgagcatttttttttttaaatgtacctattatcatttgaatgtcttttgagaaaggtctcttcattcctttgcccatttcaaaatcaggtggttttcttgctcttgagttgtttgatttccttatgtattttggatatttacccatttccagatgtatcatttatatttttttcccattctttgagttctctcttcactgtgttgtttccattgctgtgcaggtcttttattttgatgccacctcatttctctatttttgccctgcttttgcagtcacatccaaaaaaatcattcctaagaccaagttgtggagatttccccgtatgttttcttcagtaggtgtacagttttaggtcttatatgttaagttttaaatctattttgagttttttttaatatggtgtaaacaagggtctaatttaattcttctgcatgtggatatccagttttcccaacaccatttattgaagaacctgtcctttccctattgtgggttcttggcgcttctgtcaaaaatcagttgactataaatgtatgactttatttttggattttctattctattctattggttgatgtctgtttttatgccagcaccatgctgtttaattataattagtttatgtttttaagtcaaggagtgtgatatattcagatttgttctttttgctcaaagttgttttggctatatacggtctttttgtgggtccatatgaatttaaaaattgttttttacatttttgaaaaaaaatgacattgtcatttcaaagacattgcattacatctgtagattgccttgggttgtataaagatcttcctaataattcttctaatacatgaacatgggatatctttccatttatttgttttctttcatttcttttatgttttatagttttcagtatgcagatcttttacctccttaaatttacacctcagtatttaatagttgttgctattgtgagattttcataatttccttttcacatagctcattaatagtagatggaaacactactgatttctgtaagatgattttgtattacgcaactttactgaatttgtgtatcagttctaccaggttttagttttgttctggtggagacattacagttttctgtatatggttatgtcatcagtaattacagatgatttaacttcttcctttcctattaggatgccttttatttctttctcttgtctaactgctctggttaggacttctagtactatgtcaaaaagtgatgagggtcagacatggcctccatacctaatctgttgagagtttttaccatgagaccaggttgaattttgtcaaatgctttttcttcttccattgaggtgatcatatgatttgatttacacccttcattttgttatgtggtgtatcacatttattggtgtgcacatgttgaaccatccttgcatcctaaggataaatcccacttcatcatggtgaatcattctttgtgttcgtgaatccagtttgctaatatttgttgaggatttttgcatccatgttcatcagggatattactttgtaagtttctgtccttgaagtgtctttgtctggctttaataacagtgcaacactactcttgtaaaataagtttagaaatattccctctgcttcattgttttggaaaagtttgagaatttgtattagttctataaatgtctggtaaaattcagtagtgaagctgcctaatcttgggctttcctttggtgggatgtttttattactggcttaatctcttttcttattattggcttattcagatcttgtttcttcgtgattcactatttgtaggttgtatataactaggaatttattcctttctttagggtagtgcataacttcatagtagtttcttataatcctttgtattttggtgatatcagttgtaaatgtcccctctttcacttctgatcttatttgagtactctcttttttccctagtctaggtaagaatttgtttttatcttccccatcccccccccaaaaaaaccccacaatttttagttttgttcattttttctagtctttatttcaactgtgatctttgttatttacttctttatgctaacttttgggcttagtctgttctttttttagttcctttaggtgaaaagtaagattatttgtgatccttctttgtcgatgtaggtgtgtattgctgtaaatttccattaggactgattttgctgcatcacataagttttgtttccattttcatttgtctcaaggtaattttttatttactttttgatttcttctgtgaactattagttgtttgggagcatgttgtttaatttccacatattgctgtattttccaccagaattgattcttgttcttgatttctagtttcatgccattgtaatcagaaaagggacttgatatgatttctgtcctcttaaacctaagaatagtttttggactaacatataatatatcctggagaatgttccatgtgcatttgagaacaaaatgtattctactgcttctggatggaatgtttcatatatgcctgttaggtccatttggtctaaagtgtaattgaagcccattgtttcttaatattgattttctgtctagggaatcaatctgcccactgtgaaaagtagagtattgaggtcctatctccctcttcagatcatttaacaattgctttatgtattcaggtgtgtcaatgttgggtgcatatatttttacaattgttatgtcttcttggtgaattaatcccttatcattatataataaactttatttctttttatagtattgacttaaagtctattttgtctgatagaagtatagttacccctgctctcaatttccatttaggtagaatatctttttccatcccttcaccttcagtctatgtgtatgtttagtagaaaagtgaatctcttgccgggcacagtggctcacgcctataatcccagcactttgggaggtcaacgcgggtgggatcaccagagatcgggagttccagaccagcctgaccaacatggagaaaacccgtgtctactaaaagtacaaaattagctgggtgtggttgtgggtgcttgtaatcccaattacttgggaggctgaggcaggagaattgcttgaacccgggaggcggaggttgcagtgagacaagattgtgccattacactccagcctgggcaacaagagcaaaagtctgtctcaaaaagaaaaaaaagaaaaaaaaaaaaaaggaaaagaaaaaaaaagtgagtctcttataggtagtatgtggttgtgatttaaaaaaaaaaaaaaatccattctgtcattctatgtctttttcttggagaatctaatccgtttacattcaaggtaactattggtaagaaatggctagtgtcattttgtaatttgttttctgattgttttctagctcccttgtttcttttttccctactgctaccttcctttgtggtttggtggttttctgtggtggtgtgctttgaattctttcttttatagtctatgcaactaccgttgtatttgccataaggctaacttaaaacattttatccttataacaggatactttaagcagataaaaacttgcctttagttgcatacaaaaactctatgctttcacaaccccccaccttttatgattttgatgtcaaagtttacatttgttttttaaaatttgtatctcttgacaatttattgtagctacagctgtttttgtgtcatcttttaaacctaatacaaataacattgctttacctgccacttttaccatagtagagaattctatgaatgacttataccatttagttttttacttttatgtttttcgttaactagcagtcttttatttaagcctaaagaactccctttcagtaatttcggtagagcaggcctagtggtgacaaactcccttaggcattgtttatctggaaaagtgtttatttctccctttgccaagtaaagtgttgttaattaacagttttgtttctttcagcactttgaatataccatcccactctcactggcctgtaagactttttgctgataaagccactgaatctgtattggggctaccttgaatgtgatatgtttcttatctttgctgctttcagtattctttgtctttgatttttgataatttggttgtgatgtgttttggtgaactctttgggttgaatttggtgacctcagcttcctgttactgaattttgtcatcttttctcagatttgggaatttttcagctattccttccttatatatgctttctaggcctttttctttcttttctcgttaaggacctcctattatgcaaaagttagctagcctgatgtgtcctataattcttacaggcattcttttttgtttgtttctcattggataatttcaaatgtcttacctttgagctcactgattcttctgcttgatcaagtctgctgttaaagtgttctactgagattttcagttcagttactgtatcctttatctttagaatttctattgtttgtgtttatatttctttgttaaacttctcattctgttcatacgttgttttccaaatttcatttttctgtccatattttcttgtactttgttgaactttaagaggattagtctacattatttgtcatttcacagatctctatttcttctgagtctgttactggagcttcgatatccaatgtacaccagaaactttgctaattccatagtaaatgttagaaatgggttttttaatggtaaaatcagtggcttgctaatttgtatattagaagctggcttgcattggtgaagttgagggcattcgatatatgtatcctggctaaaatacttctagagaacctctccacgttgcaagaatagggtatagaaatctgaggaggcctttaacatggccctcagaaaggacacacagggcttgacccctaaacatataaacatgtacagaaatgaggtgagaacatgttttgactgatgccagtagttaacacagcagagcctaatgctggtcactgttacaaataccttgtataataaacctttaatttgagaggctgtaagccctgaaagcaaagggcttatagtacctcttgcatgaacactcctgtgtgtgctttctaagaaatgctttaaaaataatgcatgtggcacaacttgatttgacactggctctttataagctgctatcaaggttgtggggaatagctaactcctacccactttccctgacaaatagaaactggtagttacctaccaaaagtatgtaaaagctgtatctgacccaaaggccagttaggtcaaaacaccttgaaaggagctcagtttaaggaaatcagtggtgtcacagagccccactaacgtgtgtacaagttttcatagtttgactataggatgtgcttagtttcacaggtgagtcttaccttgtgatacttttagagcaaaagtcaaatcaaagatgattttaaaaaaacatttcaaagaatcataaagaataaatgcctccttaggaagtcttctggagttctgcccacttcccttaggtggctctttactgtgcccatctcatagcttctctccctgcatttggtgtattgcagagtaaagctcactgtttacaggagtggtagaaagtgtggtcctttcccggactcctttttcccttccccttctcgtttctgggaatatgtgtttgataatagaattaaacaacagactgacaaatgactaacacatttagctaagctacataagcagacgtcagtttgacgtgaagggtttaaaatatctatgaattctctggggactcctcccccagacctgaaggatcaggtgctgccttctatgccacctgtgcagagggcaaaagaggaaaaccatactcatgttcagtgtgagtaaaggggacatttgaactctgtgcagacccctcattggaagggtgtttcttctcctgctgcatccacaaagagcactccttagccttgccttttgtcagttctctccccaataaggttctgagcagagaacccagtgcagttcagagactgaagtctggtgtcccaggtctgagttctagctctagctctctgtgtaactttggcatgtcccaaagtaactttccacaacttgacaggtgttacttgagttttggatacaggtgactcttagcccatctgtgcctcagagatgtcatcacttgggccacatgacctctggacacctttcctactttgagcggcagaacagatgggagctcctgctgcctctgagcttcagtgaattatcacttgttggagggaagcttcaagcattttgtatcttttgtatctttcaagagcaagcacagtcagcaagaatatgtagcagatgctagtgaacaccagtgattagggttgaatgctggatttaaatatggagcttaggctgtgaaggaagcctgaagaacctagagccccacaaattgctctctgtgagatctgacaccatttcccactgatgagccttgggtctaataggtagcactgattccacatagagtatgtgagtgtaatacactgaaagcaaagagaataaaatgatggctaacatgatgttccaaactttaaacaggagaaaaacacataattccattatgtataagaacccacacagagatcaggagaataacctcattggagaatcaatgacctatgtggggaatttagggtagagctgagattgaaaaaatgggccaaagccaggtggccaagggccttaataccttgtatacaagatgtgtagtcaagaaagaccatgccttagttacgcagcaattcccttgggcctacaaagagctgcctagcctgggactattgtagagaaaggctactatgttccagtgatgcagggactcctccatatatatatgcgtgctcagttggctctgtaatacatcttacttttatttattaacttttcttgcacattggcttggtgcatcagttggaagtcagaggctgaacgaagtgaagattgagccaaaggaagttctcagcctttagggaggtggaattcacattaaacacacaataaacaaatgaactcacattataaaggagagagtcagaagatcctagtggctggtgtcatcgggccttatttgcccgaagtgcctattctttataggaatccactcccagggtagatgggctacatccttagtaggctttatgcctatgttctcctggccattgcctcctccagggctggcctttttcagtctctctgtagaggttcctgtggctggttggatataggccttcacagaagggtcagtgccttggctcaggttacaggactggtaatcttgctttgttaagagtaatgttatttccccatttccaaattctccagggagatggaatgtcaaagatagtatcactgtagcacctacatcctaggttccagaagcagagaagagaatatactgaagctgtagaaaggcctattagtctgtgtcagagattaactggatgtgaggaccatttctgggatggtgtatacagaactggagaactggatagggagtcagaaagagctgaagacgatgtctttgaagtttccaaagtggataactaggtcaacagtgtattattcaagaaagtattaacataggattgagatgcagtcagtagtcatggaattgaaatttcaaagtatatacctcttggatctcaggggtgttgagctgatcacctgggctaacactcctatgaccctagggaaaatcaaacagcctggtcctgtggccatggtaggggtgtcatcaccttaatcaaactgggacagtgctgttggatattcatctggaacttgttgcagacccacattttgctgggtttcaccacaaccaaggcctttttgatccttttctcggttaacatcagtacatcattgcaaagttaatcctcatataatagggaatgaaactaattgcttataaaaacaagatttttacaactctaaaattgttcaagcatacgggcatatttatagttgcaggcagtgtttcaggtgcagactgttcttggctgcagtggtggtttacagacagcatctgttcaatatttgatgattatccccgaatgttttaaagcgtagtactgggctctgctgaccgtacaacaaactggcatttttgacctatagggccctgggctaggagatacagttctgaggggaagtgaaagacagtgaacaactgcacaactgaccctttgttagttgcaataaagcaatccaaccacccaacccactctgatggctttcctactatttaaggttggtgatgtcaaagagacaccctcctgttcagtgtgcagtgagtcaacatcatttccacaaaacctccttcctgcacaaaggacttatcatagttggttaagaagtaaaattttcctgtatcagtcacaggagttcaccagttaagatactgttagctgaagacttctggggtgacttaatgaaatagctcagccatgtggtttaaaaacgagattcttccatccctccacacagctgtccatgcatctgcatcatgtcaaggctggtctccttggtggtagaaaggctgacagtaaaaactggagccacatgattccttgcttaggcacagtgtttcttcatactctcacatgggagcaggcatgttctttccccaggctcacagtaaacactctgtcaaatttcacaggcccaaagtgcttttggttatccccattccaaaccaatttgtggcaggaaagcattaccctgactgccttagactaatatacctactgcacttctagggctggggataattttgaggtcaaccattcaaactgcacggcagtcattccatggaagaagtatggtctaaatctttggggcaacctgaattcatgaaaactctcttagatttatgtaactaattttagaattcacttctgtaccatttaattttactaataaaaatactacctttaccctaaatttcagccaagcgtaaggctcccttgggacagaaggaattatcaaagctttgtgtttttatacatagtagcgtttgacaaagaaataactctgaaggaaggagaacaaccaagcagagtctagatgcacagaagtctttgaggcttggtaggcagaaggaaagggcaggactacttcaggaatacaatgtttcagtaacagaggttggggtctgttgatcttgaggagagatgaggatggactggaaaataggagtgagatagtaggagaggaaaggagatggatggtgtatatactgtatggctaaccatcaatcgaccctaagaagataatagttgttagatggttagctatttaaagaaagaaacctgaacaagtaacaatcttgagttgcaaagtggctggagtcacacaacagactaaatttctggtagaacaaatgcagcagcttatgtgaagattaccatgtctgaagctggttagaaaaggtctaacatccaaccaaagtcacagttcttgagctcggtacacagagacagactgctaacagctgatgtgtcctcagcgagagtgtcctcatttatatcctcattctcctcttctgcctccttttttgtttgtttgttttaaacctttggaaagtctcatcattcaatacagtctaatatatcacaataacagaggcggcccaatttctacagattgactaattccatccttgaaaagttcatataataaaactatataaagcatcattttcaaccatcctttagaaaaattcccctattaaatgttaactctaaatcctttatctctgttaataaccttactaaaaacttccccatcactgcctgccagggagatcaaaagaaatcacatttacgaaacctccaacacctgtacctgactgaaaagcaaacatacagacctttcagtcctgccctactattccgctcctatcacacagaggcacgtggacatctccttgggaagcggacagctcttaggtggaagctaggcctgcagtaagcaggccaggaaacatgtctcccaggacccacactcttgggagaagcacctggccaccagacagcatgtcctgtcaacctacagagttctgaaaaacaaacactggaccgggaatagaaccctgtggtcacagtgcccacagttcactaagcaccctcacaggtctttgacagaacactgactgccaggtcccctcgtgggcagagaaatggaagattcccaggcccaactgagcatctcagggaagaaccacaagcagagcaactgccagagctggtcggctagcgttggcaaccagggaagcaagtgctacaccatatttggagagagcataaaacttaaggaaatagagaagtcctactcaattctgttcttcaactggaaacgagaacttgcgaaaaagaaacccagttttctggagtccatggagaaatatgaagccaatgctcgactaacagagcagaaagccttttataaataatgccagtcaaagctccaaaggtcagagctgatgcaagcctgactgttctgacaatttcctaggttgctaggcaacaaggagctggtcaaacagctcaccttcgaggacgtactttataataccaccctggtagacgagcgcgaggcagcagtgaaggcagtagtcaagaacaggagagggaggttaacagcaagatgctcttcagacagtctggacaaagacagtctctacccagctctcaggagtggcctgcttaagaaggtggaggcccaggcagctcccagggtgaccctaaagacagactccaaggaaaagggtgtgagggcaatggtgaataggaggaggtcccagtagacacagcaagtcagctcaggttttatctttagagtctctgaactaaagataagtgaagagaagccttctgtggacagcattccagcactatgggaggggaaaggtgccacgagagacttctccagtggggcacacaagcattgtgcagtgatcctcaagatccagccattggcaggaaatcgaaaggcaagcttcttaattacatagtctatggagacagaagtgtggtgcacccccaaaataaaaggccaagacccaggaacaacctccacaacctggagtatatacaaatgaacccaggcctgctgactcagatccacgccatcctaaagcagggtattctcacgaatgaaagggctgagtatttggtgtagagaatcagaagtctcccactgcccacacattttctcttcaaagatttcttttccaagaacccattgaataaagggagggagggagcactgaatgccccagacatcagaatgcatgatgcaggaagaggacagtaaatagttctcaaagagatcagaaaataaattggaagcaatttcattaccacaaataatagaccttttttctaaggcaccccttccctttccacccaattgtcattcagcaactactgaatacttaccaatgaaaaaccttacccctgacctcaaggctgctcctgagctctggtagaaaatgctttcctcatctataaaacatggcaagcaaggcaggatttaatagtaagaaagagaactcagggcacagtagcactgcaggacttcaaatggaaatatggagacaagcagtgagaacaggcagcaaaagcagggcaggtgaggctgggaccagggcatctggaactttccacaccagcttggatctccatgccaaacaacagttttcaaggaaaggtatctaagaggaacatgactctgggaaactttttggcagtattgcttactgcatactagaaagtaaaagaatttggggaacattcactaatttgcttcttcaggggcttgggtagggaacaggaacaggaacctggctctaatttctgaacttttatcagtaaaaacaatccaacaaatgaaagttagtcaatgagagaactgggagggtctgccctccctcctccttccttgagtcaagccttcttgggggggacctcctgacatttaattaagtgaaggcaatgtccactgaaggaagcggacctgaaagtgacacgctactgtgaaatgagcatggagtaggagcttgttacatatatgaaatggccagtgctcttgagcaaagcgcttcacaacttgagacctaagttttctcctccatatgctgagggctgggcaagatgatctgtcaggccatttttacccctaagccaccaaaatccaattgctttagcttgtcacaaaagcaggtatcgaatggctatcctgcagtccctccagtcaacatccagactttttccctgaggcaatataagacaacagttaacatatttttatcagtttaggtggtcatgagataaacatatgggaggtggtagtttttcacttaaatgaatataataatggtacagatctctttgagtagtatttgtttcttaaatatttaagttccctaaagacggtaagaataacccaagaaagtgaaattaatgtcacaaagcacatggctaaataactgcaggtttgcagtgccatgtgtgagatcagatgacagaagggaggcctaccttcaggcagaggcttctcatgttccctggagtggccatgtgctcttctacacgactgcttccacttcggttacgtagaagctatttaaagcacacagatggttgtgatgagataaaagccacccttaagtgaataatggaaattaaagcatgatttgagggtgggggtggaggtgggagtagagatgggtagaaaggagtgcaagggaaacaaaggagccttcataacattaaagtcacttaggataacatgattgatttactcaacaccttcttaggaacataaagcaaacaagtgggttttccttttactgcttttctgaaatgagctacactcaagaaagcaacatgggggttgtgctgtccctgcacagtggcaggagaatatgaggagcagctgaatgccagaacagctccatccaagatcatttttcacacgcatgaaccattcttatactaccttttactggcaatttctgtagaaatctggaagtctggttgacaaatcaggcccttgaactttgcaatcacggtggcattcatatattcattcagcaagtatgtgtgtacgggacagtggagcaaataaaacagatacgttcctactgtcatgaggcttaacatttaaggagggaattaggcagtcatgaagtaaacataaaaatacagattgtaataggcactatggaataatgaataatttggggaacacaatttaaatttgaaatatatctcagttccattaacacatgttgaaggtgaatggcatggcacttttttgctggatttagggcctggatgcaagcatattggggtaacttctgaaatgcatcgtagggtaatgcatttcctcccatttgggcccaagtgtattatttaccacccagttgtgatgagctgggatcctcctgctcaatctcagcttgaagcacttggaggttacctgcctgctgtgggtgattattttggagcaaggtacttcatttgcctcaagaaacagatttgataccactactgtccccttttggaacagagaagtaggcaagaccccagtgtgaggcagagtgatgggatctttaggatgccagagtcattacatcattatgtaatgtatgtaattgatgtaactgatgattttggagtttatatatttccaaagtttcaaaatattttcacttggctgatttatctttatggtgatgacagtaagtagatatatgccctccttaaaagttacagtgagagttgacattgggaaaagggaggcttggccagggttatgcagacacagtacggaggaggatggaaagtttctgagacaccccagttaactgcgtggatccacaaagcacatgtacagtctgctctgtgcactggaggtacagccacgaaaaagacagtctctgccctcatggagcttggtgtctgtctactgtagcagacaaaaacaaacctgctgtttctcatttgcctctgctgtgggttccctgtgtaactctcaaatgctagcatttccatggatccttgtccttctctcctctctgccttttccaggatgagaattttcctggccacgggttcagctatggtctatgtgctagagtcatacatttttatttctgtgcacatttttctctagacccgtatttttaactgcctcaggacagctctccctcgatatccctcagacacaactcaaacgtcattcaattctactattaatacttttcccttcaaaacccactcttcttctgtagacccaacagcaacactgtccacccagctctcaaaacctgaaatgggggagctgtctttgactcaactctcccatgcatgagcactgaatcaatcaccgagtccctagcatgtcttggactctggcctcccttctatcctcagattgtctgccttttaaaaattatagcaataacttaactgcaaagaccacatgtacacttgtgctctttcagtttgcaataaacataaaatgtaaaactgattgtctttgcttcttagcatctgcaaaataaagtccaaagtccttggtatggtctgtaaggccctcattatcccaatctcatcttgattccttacagcctgcactcagatatactaaagagcgtccgcctgtctgcctcacacacacctatcctgtctgtcaagattcggcttgaccttcatcacctatctgcagtatttttggatttgaattctctgcccacattgtactttcacatacttcttttatccttagtggtttgtacttatgcctgctctaactagactgtctccctgtagtagactccttgattcaacaaagcagctctccatcagcctgaaatccgtggcacccggcaaaatggcaaacatgcaataggtatttgctcagtaaatgttaatgaaaggaaaaaaattcaaacttcagttggaataggattagagacaacttaaaaagtttcccatagaaatcttcctcatcataaatatcatcatcctcaatgtcccgagtctttccacaggtctgatttaccaaatgaggaagactctttctcactgtgtgtgtgggagaggcaggcgcagaacatgtttttttttctgcaagtctgctctctggattcatttttctggggatgaaatctcaggctgtgtagcttttctggtccctttttggtaatcaacaaatcatcagttgttctagggtattaaaaagcccacacctttgaaacatcaagatgccaaactctctcttaatggaaaacataattccgcctcttactgaggcctttgagtgggaagcttaaagacagcagtgtggggaaatcggtttttcttttcctccctccaccttctttcccattcaagagctgctgctgccctttctggaggggagggaattagaagaaaagatcctgccttacccagtcactgttaattattactctgagccagggtggtgaatgactctttcctggaatacacgctgctgggaaccaccgctgagattctctaagcaggcagcttccaacctctcctccctcaacagcttcaacattatatggcactcagctgcagggtgcctggctccaggcaggcagcccacttgtgcagggtagttttccagatggctcatagtccatctcttttcagtgaccagtgtggcccctgggaaacatacgtcttgactccattattggtgggagtactctttagttagttgccacaggccacttcagacatgtcttaccctgagacccttttcagagtcaggtaccatccctctgtctcctagcatctaaagatcacagctgaaggtctccaagtagttcacttaaaaaatacctcagtaggtgtaagaacagggaaagcccccaattcattctgagagctgtatgactctcatccccaaaccagacagatatataatatgaaaactacagaccaatattccttatgaatatacatgcaaacattctaaacaaaatactagcaaaccaaatctagcagcagagaacaaggtttatgtagcatggacaactgagattatcccaggaatgcaaggttaattcaatatacaaaagtccattaatacaacatattaatagaataaaggacaaaacaacatgacaatcttgatacaaaagaagcatctgacaaaatccatagcccctctttttttttttttttaattaaaaaacagtaaactaggtttaatagaagaatttcctcaacttgatgcaaacccacagctaacatcatactcaatgctgaaagactgaatgctttccccctaaatcaggaacaagaaaaagatgtctgctcttgtcacttctatccaatactgtactggaggtgccagccagtacactaagacaagaaaatgaaataataagaatctagactggaaaggaagaaggtatttctgttcacagatgcatgatctcataagcaaaaaatactaagtgaccaaaaaaatagaattttagaaaagctacaatacacatgatcaacatacaaaaatcaattttattactaagaccagtgatgaatacaaaaataaaaattagaaaataatcatataaagtggcatcaataaaatacttagaaaaaaattaaagaagtcaagacttgtacactgaaatctataaaacatcactgaaataaactaaagacctaagcaaatgcaaagacatcccacagtcatggaatagaaaacctaataccattaaaatagcagttatttctcaaatcaattcaactaaatccctatcaagatcccagctttgcaggaattgacacaatgatcctaaaattcgtatgaaatgcaagggactgaaaatagacaaatgattttggggaaaaaaaaactggcagacttgcacatcccaaatccaaacttagtacaaagctacagcaatcaagacagtgcggtgctggtgtaaggatagacatatatgacaacagagttaagactgagaatccagaaagtcttacatttatggtcaactgttctttcacaagggtcccaggaccattcatggggaaattaaaatagtcttttcaacaactggtgcttgggcagatggatatatagataccaatgcacttatgaaaaaaatggatgaaataggaagcttcactacattctactgcatgctgggtcattttcaatcatttaggtggcaacactgacaagataacagaaaaatggaggcagtaacatgtgaaaggcaaaatggttgttgttttttaaaaaagggacaatatccatcatgaatttacttacactccaggcaaaggttattaaaagaaaaaaaaaattccttaactgaaatgtggaaggggtatcaagagcagaccctacaagaattccagtgactcctcactgttcaactaagagatgtaccccaccatgccgtgctaccatggaagcattggaggcactctgggggttgatgacgtcttcatggatgaggtactttaaaatgtggtcatgaagagtatttgagaaatatgacaagatgctgggtaggaatgcagggagaaaagtgtgtaacccacggccaaattggaaagatcagtgagggggcaatttgtggaggcactgaacgcagagaatattaaaattagcaagatggtgttctagcacaatgaaaaggattggaagagggagatcagagtcagggaattaaattaggcagctgctaagaatgtccaggtgagtcagaggatcaggacctgtaagggcagtataaataaaggaggaatgacaggagggggtttacggggaaagaattgacaacctgtgacaattgaggaatgagagattttgatgattggggtgaaggttacatttcgtaaaaagaaacaaagaatggtcgacagagacgcaagatgaagaattttgtttttaggcctactgactttgaggtagcgggaagaaatcctggagacagaggtctgagtagaagatacagaattggggaagaatctttgggagtgcctgaggttgaccagagagaactgggcaagaacaggtaaggactttaagcagaactggaggagtatccatccaaaatctgggtaaattgggaaggaaaaataagcagccagagaagcaacagctcaagttagggtacagtcaaggttatagatacgtgttactgattttggcaatgaggaggttataaggatccttgaagactgtactttcagtgaaactgtcatggattagtagcctttcacagtgatatctaccccacacctgcatcgaaatcttgcagtggctgttaacaaatgccaacccactaacagggaggggaaaaaaagacttgggactctgtacttgtaaaaccctctaccctccccaggcaattctttacacactaacactgttgaggtaaaaggaggcaaccaaatgagggagcaaataaaatggaaggtgtgttttggattatacagtggcccatggaagtgtgggaggggtacagatggcccttagacagacactggtggaaagtcagaaaaaaaaattgcggtaagcaggtaaagggatcaagagtacacaggaactggtcttgggacgacatttctttctctgacagtttgtatggaattcttggggaaattcctcaaaggggcctggaatctcagaagggtcatgtttttaatgggaacagggagtgatgctgccccattacaaccatctaacagaatgtctgtaccgaggagggaggaataacagcaaggtctgtttgaagcctcattttcaagtttctttttgatatggatctccctatacaagcaagcatccccaaaagtagttatctcaggaaaccaaggttaggatgaccagctcatttgctggagctgccaaggtccagaaaagtttggctgcaggctgttttcatgttttatgtttgaaatgttctacaatgaaagttaaaaaaagttagcatttatttggaaaaccagttactttagtttatggttcctttttttccctccagagcttcctggagattgaggtctaattcaaagaaaaccaaactatacaatagagtacctgggcaaaaaagtacttttataacataacatttggggtagaggaagtatccactatcgtcaaaacttctatgttttcctcttccttattgttcagggacattccatgcagcaaaagtaaggggagtgacaacatgcctagcataattaagcaagctagagcagctagtctgtgcaactgatgattttttccctctaaaattttaagggtaggttcattgtgactctgttagaagtctacttgatgtgaattctgtatctgataacctatttcaattatcactttaaaatttgtcatatggatacattattacaatcatagaacttcagtaccgtaataataaaacttgagaactgaagagcacacatttcttcacgaatttattatataaaacgccctcagagtatttaatttctcctcactttaattacacattaagaagcacagtggatgagaagcctttaagatgactacagttgcacgaaggtccctttcatcaaggtagcgtacgtaccttaacagtgttctaaaggctggcccagaaaaaccccatgttaccttatcacaatatggaaagcattgtcttctttttccactaaattatggtgaaaagtgccacagttttatttagcattatggtacataacagttctgtctcaattatgaaaaaattaaaataatcctgaaagacatcctttttctccccccaatgatttgaaagctgcatttttcctgccaatttcaaacaaatcatcaggttgatctacagtaatcagttaaaacaatcaccaaggcacaagctcagcacattagctatagcttgtagcaaaaggatatatcaatgtctcaccttagttaaaaatacataatccttttattttataatgcaataaaagaaattaacatcacatacacagaagactaggaaaggggaaactacttacttccgaaaatccagtaatgtaaacctacttgtacttttccatagtacatgaaagtaatgtttaacatgttttgaattaaatttaacctgtggggctatacaatgtaattcttaggagtaatagtttcattcatttccaggtcagcttactgtatgattaagtaacacaaggcacagtagccatctttttcattatgttgcaacactgatcacgtgcctcgataaaatggctgattcaacaagatgatggcaacacgaaggggagactttggattgtctatttaaaatctaggtaataagtaattaataaaaactctatcttaagtgcactttcacatgctttttgtttataataaacaacaaacttcctaactttgttgcaataggcttgactaccatttcatttggccaaatgcactttccccagtaaacttaaaataacaagaacaacaagaacaaaaatccctgtcctttcatatactaagaaagaggattggctactgaaacagttcattgcaagacacatgaagacaacatactgtggcatgagttgtttttttaatttgttgtgctgttactaaagttctgagggctgcagttaaaacattccaatttctcccttccatctttattgattctcaagattttgcacagaaaactctttgggggctagaacagcagtaattgcatcacactgtttcaaagacttcaagtttcaaaagcaaatcattaaaaaaaaatacagttcctgatttgagttagatacagggacaaaaaagtagcacatacttgaaggttacatggtctacaaatggtggcaatatttttcttgggagagtagttctgttggtatatattttttaaatactcaaaaggctcaacctcaagcagtaataaacacaagcaaaagtgatttaacccttaaaataaatattcagaaaaacctctctgtacatacaagtgaaagaatatgtaacactttcacgcaaaaaaataattataataataataaaggatttgttcatatatgtagctgaaatctgctgttccagcccacatgtccccaagaaagaagggaggcacagacagaggtgtgactactgtggttcactatcttacagcctttttgtactgggacactatcaccaccaaacatttatccctcttgttatatttttaaaattttttaaattttttcttttttttttcttccttttttttgttttattttgttttgttttacagcatgccaaatcctttggcatacgtgatggccttcaacaatctctctttaagtttttctttgcttgaatattccggaagtaaaagcacattaaagcaagtatgagatgtaggtaacctaaatagagaaaaggggaaaaaacaggaaaataataagtcatgggaaatacacttagaattatatatagttgagatggtttgcaatgccaactatacattaatgcaaatcataaactttttgttgtgtaactaccaagaatcagtttgtctttatcctataaattactcaaagctagtaacaatgatgataagatacttatccattgagtttttactacataccagataccgttttaggtatttaattattacagttcatttcactaaatctttttccacaacaaaaccacagagaggacatcaataaatgcacttcagaggttaggtcactgagaagtaacttcctctaaggtggagaaaatattcaaacctggtttacaacatttcaaactgtgtgctcttaaatgcttattagaaatactgctggcaatatgactatgaaaatgataacaggattctagaataatcgaatgataatcttccaagcctcaatgtaaccattctaaatagattatcatgtaacatggctttcaactaacaagctgggaatcaaaaaagtaaatgaatcatactaatttgaaaaattccaaaccaatgtgagtcccataataatttttaactagggcaattccttaaaagtttcctcacacaatgacagcaaaatattttctcaattgtctaatatgatttgaggatttgtacataaaatcacaaaggtgcttagaaactataaagacagttcatatgtgtgtgatgaggaatgcaaggttttcagtaggtatagagtcaccacttaatcattacctttctgtgtctgggccatttttggctataatcatctttaattttcctagtcctcccacaggtgctctgtctgtgcccgttgtaaactgcaagaagagtcttttctgttcatctgtaaatgaatgaacgatttcccagaactccctaatgagaaaaaatacaatactggtttcagtttggcattcattatgactggtactaatataagcttatgatttgcatttaaactatattaagagacaacttggaagttaattatcaggataatatcacttctggtgatttaataatttccaagcaaatttatcttaaacagttctgaatacataaaaatttagattacaatatagtaaaatattagtactacaatagtaaaaaattgagaaaacccaagtgtgtaataacaggaaatgactatgtaaactatggtataatcacattatgtagagtcagtaacaaacaaaagacaaaatcctatgaattgaaaaagactgaaaggaatattgggaaagattaactccaggtgcctttgggtatatattttatttatcctttctccattattctccttgtctactcatcctttaactcagctttgggggggaaaagtgatacagattaaggacaaaagaaaaaaaaagaccccctgccccaaccaactggccccaaatgcaaacaactatatacatacctaatagcagtaatacaaaagttcaatttttataggaactagaatacttttaacaagtaatatgtgctgtgtatggaggaggagaattattctgacatttctgccacgtgcagttattttaagagaatgatttatcctctggcattcctaaaatctatgtaataaaagctatgttttatgacacttacgttagtttgagttctaaaaaacgaaatacaagctcataaagtgcaatcttgaagtttgtttgaataatcaggcatctataaaacatatatacactagttcatagttaaataattttttttttttttttttttttttttttaagacagagtctcactctgtcacccaggctggagtgcagtggtgcgatctcagctcatgcaagctccgcctcctgggttcagaccattctcctacctcagcctcccaagtagctgggactacaggtgcccgccaccacacctggctaatttttttgtacttttagtagaggtgtggtttcaccgtgttagccaggatggtctctatctcctgacctcatgatctgcccaccttggcctcccaaagtgctgggattgctggcatgagccaccacgcctggtctatagctaaataatgttaagattaaaacattttttttaaaaagtatttttagtcgcttatataaaatgcattttaatatttattcagaaagttctttccagagcctggtgtggtggctcacgcctgtaatccgagcactttggaaggctaaggtgggtggatcacctgaggtcaggggttcgagatcagcctgaccaacatgttgaaaccctatctctactaaaatacaaaaattagccgggtgtggtggcggatgcctgtaacctcagctacttgggaggccgaggcaggagaatcgcttgaacacaggaggtggaggctacaatgagctgagatcacaccattgcactctagcctgggaaacaagagcaccactccatctcaacaaacaaacaaacaaaattatttccagaatgttagcagagaacaccacacatcccaaatcagtaattacaattttctagtttttgatattctaatattccaacatactatttttattaccaaaatgctggcatttttgttgctgcaacaccatttatctgaaataaattaaaggttttattagaattcttggctttctccaatctcttgccacttcccttccctgcccctctacgaatctaccagtcagccagagaaaacaaaaaagaaacacacaaccacagaaaacgggacgtgaaactagcaggagcatctctcagttaaggaggaaaggaatcagaccccggttcatgacattccttttggggaggctggcaagagaaaataagtctgctgtagcacacagccctccaacatagcagaaaagctgccctgcagtgggtggtaataaagcctcctcaaactgcagtggggctctgaagcttaactgaaccagctacacctaaggaggcagatcaaagagcaccaccgaagaggagagacagaccctgcaggaagtggcagatgagtagtggtcacaatgaccagtcccgctatatagctgctgctttggtctttcttttaaatgaaacctttaaaaattttatacaatgaaaataattagggaacaaaatttgtctcttcctataagtgttatgtgtgttacattaacacgttgaattaaataagaatgcatttatttagaaagctgaagaaaaaatgaagaggcttccaggtttccacaaaaaagtggtggctgtatcgatcacatcctactaacatctctaaaaatctatccagatcaaaaaggggagaaataaaaaaaaaaacccctatgacttaagtctagagtaaaactaggagacagagcaataaactccaaataccatagaagtggggaaatgagcagggtccagcaggagctacattgaagagtggcttgtgcagaatcatactgattagggatcacctaaggccagacggcacccgcctccaccacccacccctcaacagagcactactgagggcaggttagagcactggcaacggggtggttaaaggaaggactacagaaaagtagttgggtccagcaatggcaggctcaggaatgcaccatgcatgaaaggaagacgggtaccttggaaagcagaagtgtcccttaagtggctgtaaagaggtggaagcagctaatgaaaaagaatcttcattaagtggatggagctgaaaaatcagcaagtggtgattctgcccttactaaagcaacagaagagggacgccttcagccaggacccctaaaagccatacaaattcctctctgctccactctaaggtctagtaataacatgtccagaaaaaaagtaacatctattatagaaacataaacaagaaaaacagaattcctaagtccaaataaagttattatggaaagagtctggcaaatgagaagcaaaactttccggtagacaaaagtacaccagaaaaattcagtcataaacaacaggaaactcgtaacaccacattccaacacaaagggagaatgtagcagcagacaagacagaccaccaatgatgagaaatacaaattcagagagaaatgagcacatcttaaatagaaataagaatactaaaaaatactgaagaaatatgcaaagtaattttggaaataaaggctaattttattataaggtgaccaaagaagaagcaatatgactaaaatttctactgaggacagagtctagaaaattaaaaaacaaagaaaatgaataaaataaacctaactaaagaaatgcgtatcaaagcatagtaacgaaaaagattaatagctgactacataaacataaaagctttcacctggcaaaaatgctataagcaaggttaaaagacaaatggcaaactgggaaaaaatatttgcaaatttaccagcgttaaaggactaatctccttaacatataaagtttctaaaaatgaagaaaacaaccgagcagcaaaatgagcaaaagaccatataaaactataaacagctcttaagtacaagaaaaaatgtccatcatcattcataactaaggtaaactcaaaaattgtaagtatagtaaaataccatttctcaattggcagataagtaaacatccacatttaacaacacattatgtttggaaagttttaagaaaagagagactgttgtaaactggtgggaatgcaaaatgttacttttctgtgaaggagaatttggcagtatctagcaaaattatatatgcatctaccatttgatgcaacaatcccacttctaacaatttatcttaatgataccttacatatgtaaggaataatgcatgaacataagaggattcactgtgacattagtactaacagcaaaaggttaaaaataacctcgatgcctataaatattgataagctatgccgcatccacacaaagtagcagtattcagtcctacaaaacaaaatggaaaacacctctgcaatgatgtaggatgattctcaggatacactagaaagattactttcctagttctgtcctctgataaggcctacaagtagtaacattcaaaaccaaaggccatactttgcatctaaaatctgacttctaaatgccattctccaacaatttattggaaaaataacttattccaggactgagactgaatgttcgagattagctagaaatttcaaaatctaatagagtcattttaaaagcacaagaaggctaaggaatttgaatatcatttagagtaatgactgtgaaacatattaaatacaaaaacactgagttcttaatattcaaaaaggcagcaaaaccaaccaaaaaacaaaattaaattgtcactattaaagttattacattaacttcttactctaaaaaccttaaatctattttatcatgccttttcagtagaactgtttttcaaggtaatcgaatggcatccaatgatgagaaaaaacagtgccaggtatatatgtaggacaagcagatggaatttttttttccctaaacagccattttgcaatcccaatgagataacagattaatgatactgataaatacggaaatcaggtgaagggcagatggcacgttctggaaagatgatgatagcagtgacatagttattatttatttatttatttttttggttttattccctcccaacctcccctacaaaaagagcaaactgagaaaaccaaagacccagagacattatctataacaaaaccatgaaccattgcatataagtggacaaaacaaagctctgacaagtacaagactggttagtaaggaagcagatggaaggtaactgactgggtttcttacagccctgtgaacaggaaaaacctcaatactgccaacccactggaaagcacaggccatctgaaaacagggctaaaagtttaaaaaagttctacaggatctaatttgcagatgattacaaagggatcatgatgcagtaagctctgggcccttaaaattcccgaataccaaatcctcccaccaaaacaaaccatgtaccaaggaaaaacttgtgggaataacttccaaatggaccaaatcaaagataataaagaccaaaaaaagttcaaatagtgtgtgtggggtagaggagtaaaggcggcagtttcagaaagcacaagggcatatttttgaccattttacaaaaacacagacttctccctgtccctaaaaagcaagaaaagttatcctggcctatctctcccttgtgcaagtatgagacactcatttccctcacaaaaaaagaaaaataaatacataaccaacagaacagagtgcaacagtataattattagagaaagagtatgtgcatatacatgagaatggtgtccctacagaaaatgaaagtaaaccaaaaaatatggaaataaaacatgaaaactgtaaacaaatttcaaactgagctaaaaagaattttaaaaataacagatccttagaaatgggaaatttcagaatgagggtaactgaagaaaagaaagccatgacacaactaaggagtaattagaaatgcaaggaaaaatatcacatcaaacacacaaaaaaaactaaaactaaattagaagaaacataaaggtgaataaaacaatactactactagaaactgaaggcagaggaaaaatcttaaaatcaaaaacaagtaaagccatgcctgagactctcctagatggtccagagacacagtgatgctgtgcactggcaggaggaattctgctgtaactggtcctgggagtgttcacctttcctgtaagtgttccacagcccagggacacaatgtggtcaggagcactgccaggaacaccagcaagggggagcctgccacaataggcacaaggctcacgaagcactctctggcctacgaaaatctagtgggggtgctcttccctcacccaaacacactctgtgcagctcagcctggagaagccccctcaagcagcactactggaacccgtgcgagccccagtggactgagataaaagcaacaaaccaaaatagcaccacaaaggctctgaaaaatggtcactggaaccacagcccacaaatatatgctagcacctacatgctaaacctaaacaggttactactgaagttaaaattttttaaaagtacagagtctcctgtataataactaaaatgtccgagacacaatccaaaacttatctgtcataccaagaaccaggaaaatcacatgaaggaaagaaaatcaacgccaacactgggatgagtaagatgttgaaattatctgacaaggatcttaatgctgccatcacagaaatgatttgacaagcaattacaagttctactgtttcaaaaatgaaacaatagaaaatctcagcaaagaaacagaagttacaaggaaaaaaaaagcaatggaaattatagacctaaaaaatacaataggagaaaaataatcattagatgggctcaacagtagagtgaagatgacaaaggacagaaatctgaacaaaagagagaaaatagactgaaaaatgaaccatacctcaggtacatgcggaacaataacaaatgactcaacatttgtatcattagaggcctagaatggagacaagagtgacgctgaaagaacacctgaagaaataatggttgaaaattttccatgtttggcgaaagacacaaacttacagcttcaagaagctgagcgaaccccaaacaacataaataaaactattcttcaggaataaagggaaaataaagtcatcttcagaaagagaaaaaaagaatttctcactagcagaactgcttttgaagactggctaatggaagtaataaaagatggaatcttggaaaaataatggaaataacagaaacatgggtacatacaacagagcatcactcccttcataagttctataagtcatattggataactgatacaaaaactgttaacaggattaatcctcaaaacaatactatttaaaagtggggaaagagacgtaactgaaattaaggtttctacatctcattccaagtgatggtattgatggcagtgaatggtgataagtcacattatctataatgtgatgcccacaatgaccatgaaaacaactataaaaaacacataaaaggccaggcacggtggctcatgcctgtaattccagcactttgggaggctgaggcggacagatcacaagttcaagagttcgagaccagcctggccaatatggtgaaccctcatctctaataaaaatacaaaaattagccaggtatggtggcatgtgcctgtagtcccagctacccaggaggctgaggcaggaagattgcttgaacctgggaggccgatgttgtagtgagccaagattgtgcgactgcactccactgcactgcagcctgggcaacagagcaagactccatctcaaaacaaaacaaaacaaacccaaacaccaaataaatcaagggaaaatcttaaaaaatattcaagtaatcgtggaacacaataaataaataaataaccataaacagaagacagaaacagaaaacaataaaatggcagacttcgccctaacatatcaataattaccttaaatagaaatggtctaaataaacaaaaggtagagactaacagtttttattaaaatgacaactatatgctgtttacaagagattcatttcaaattcagcaacacaggatgaaagtaaaatgatagtaaaagacagatcatgcaaacatttaaacagaaatggttacattcctatcagattcagagcaaagaaaactgcaaaacagaaaaatcttaaatgataaaggatcaatcaccaagacatagtaattctaagtgggtatgaaccaaatgacagagcctcaaaataaatgaaacaaaaccctatgacagagataaagagataaatctcagaagcagacctatatacatattctcaactgatttttaacatatgtgaaaaaaacaattcaatgaaggaagaacatacctagaaaatacacaaaaaaaccccaaatggactcttggtatttaatcccagagaaacacaaactttttgtttataactaacatcacagttaatggtaaatattatagtctctctcaataaaatgaggaataaagtaagaataccttctaccgaaggttctagccaatgcaacagaggaacagtaataaatcacataaagattggaaagaaagaaacctgtcttgatttgtagatgacatagctggttaccagaaaaccctatgaaatctactaaataactactagaatacatcaatttagaaaggttataggatacaaggtcaatatataaaaatcaattttatttcaatatttcaatatagtagtaaaaaacaagtgaaaagcagtatttaaaaataccactaatagcattagaaacatattttaaatgtattcctaaccaaagagtaaatgatttcaacattaaaaactttataaaactgctgagataaactaacaaacatttaaataaatggagagaggtacggtgttcaaggattggaagaatatattgttaaaatgtgaattctctccaaattgacctaccccgatcaaagcaacccaaatcaaaatctctgcaggctttgccctttttttcatttgtaaaaattaactgattctaatatttatatgcaaataaaagagtcaaagcaacctaatgaaaaagttgtgggactcacagcatctgatttgaagctgcagtaactataacagtgtcgttttggcaaaaggaccaaacaaattaatagaacagaatggagattccagaaacaaggctcacacacagattgattttcaacaaaggtgcaaaagcaattcaatggggaaagagaagtctctttaacacatggtactggaacaaataaataaaactatttagaaaatgaatgacatccactatctaacagcatcacaaaaatttactggtggtggatcacagatttacacataaaatttaaacctatattatagtattagaagaaaaaataagatatttgtgcctttgggctaggcaaagatataaaaggacaaaaaaaataaaagaaaaaatcaattagacttcaaaaattaataatttctgctcaccagaatacacttaagaaaatgaagccacagacttggagaaaataatcataaactacatatcagaaatgggccttttatatagaatatacggtattccccacttacccatggggaatgctttccaagacctccagtagatgtctgaaattgcaaaaaccctgtatataccattcatgatttatttttccttcttcacaattccataaatactcatttttaccacagattttagcaacctcaacatatgatttttaaattctttccttaaaggaagcactttccccagcttctctttggcatattcgaatttccaacatcactgctcttgtgcttcagggccattattaagtaaaatgagggttacttgaacacaagcatgcgatactgcaacagtcgatctgaccaatagactcaaagtggtgggtagtctagacaacatggatatactggaaaaaggataattcatgccctgggtggaaaggtgggagatttcaccatgttactcagaatagcatgtattttaaaacttaagagttgttggctgggcgcagtggctcacacctgtaatcccagcactttggaaggctgaggtggaaggattgctagagtccaggggtttgaaaccagcctgggcaacacagtgagaccctgtttctacaaaaacaaacaaaacaaaacaaaacaaaaaaactaaaaattagctgcacaactgtggtaccagctactcagaagactgaggtaagaagactgcatgagcccacgagtttcagtttataataacctgtagtcatgctactgcactccagcctggatgataaagactttgtctcttaaaaaaaaaaaaccaaccaaccaaccaaccaaccaaccaaccaaccaaccctccctccccaacccacacccaccaacacacacacacatcaaaaactcttgagttattcatggcattttctacttaatatttttggaccactgctgatcaaagataactgaaaccaaaaaaaaagcaaactaaagataaggcataatgctatattttaagaaaatatctatagtcaatagaaatacaaaaatccaatattaaaaatgaggaaaagacacttttagttaaatatgtacctactatatgctttggaaactccactcctacgtgtttgcccaggagaaataaaacatttccacaataagactagacagctttattcacaatagttccaaactggaaacaatccaactgtctaccaacaggtaaaaaaacacattttgcatattcatataatgcaacagtactccataatttttttaaaggcactataaatcaatgcaataacatggatgaatctaaagagtctcgatgcagtacaagtatataagattccattcataagaaattctagagcagacaaaagtaatgtacagtgacagcaattaggacagttattgtctgttctaatgggggacagagattcactggaagggaaaacatgggaactctgtgttaatggacatagtctataccttgactgaaatatggttacataaacgtaatttttaaaaacaaacccagttaagccctgggtatttcactgtattaaaattttaccccacacaacatcgacaccaccattattaccaccacattgattaacatttagagagcagttagggaatcacattattttgaaaattagtaaataatgggaaagaattaagcattattgtatctgataagtacatatttatatacatgtatacaggtcctatatgtggatctgtaatttagggtagtcatagagttgatgagaaagagtttttcttaagaagtattacaggtaataaaggaacgaggaataaagaattcaaatatcacaattttgcaacccttaatgaattagcagatctaggcaatcagaatctatgataaaaattactagaaaagacagaaagcaagtgagactttaagttattcctgtaaaccaacatctatgaagtatttgggaaggaaataaagtctgaatctgtttttcgttttttttgagacagagtctcactttgttgcccaggctggagtgcagtggtgtgatctaggctcactgcaacctccgcctcctaggttcaagagactctcctgcctcagcctcccgaggagctgggattacaggtggctgccaccacacccagctaatttttgtatatttagtagagacggagtttcaccatgttggccaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctaggcacggtggctcacgcctgtaatcccagcactgtaggaggccaaggcgggcggatcacctgaggtcaggagtttgagaccagcctggccaacatggcaaaaccgtatctctactaaaaatacaaacattagccaggcgtagtggtgtgcatctgtaaccctagctactcaggagactgaggcaggagaatcacctgaacccgggaagcggaggttgcaatgagctgagaccacgccaaactgtactccagcctgaatgacagagcaagactgtttcaaaaaaaaaaaaaaaaattaacaaaatcttatttctagtggtttactattaattatgctggcaatttttagctgaaatatattaagcagccttgctgttatttttatgaattctgcaacaataataccaaccaaaatatctatacaggcatatcccagagatactgccagttcagttttagactatggcaaataaagtgattatggcagtaaagtgagtcacacacatttttttgtttcccagtgcttacagaagttatgtttacactatactgtagtcaagtgtgtaatagcattgcctaaaaataagtacattatcttaatttaaaatcattgctaaaaatgctaatgaagtgagcacattttcttggaaaaatggtgctggcagacctgcttgatgcagggttgccaccaaaatcacaaagtatctgcaaagtgcaataaagtgagatatacctgtattgtcctttttctcctgttattacaagcactattttaagtcttcaactacagaatacttgtagactatttaatgaattaatattttcatcatatttatattgagaaaattaagctgaatttagttagaaaaggtttagaatatcatcaactctgatgatgagttggaagctactttatctgtcatttttcacataacactagcttgcccttcaaatcatatatttaaaaatgaccttaagatacacaccaagtagggattatgttgttataaaaagctagaaataaaattaagactttaatttcaaagataatttctctataaagaatagcacaagatatgttcaactattctcagagatgcatcaagatatgacttcataactattagaaattatatctatgatcaatcatattacagagatattgctgttatactccttgtgccctttaatgaatcacctttgaaactgaataggtagcagcatagaggttgctaagagtaaatacatttaccactgctgccagaaatgaccaaaggtgcaccaaaaagaagaaatactggtgaattcccacaaactacaatgaagaaccttataaaataacagaacaaatgaatataacgtaacatacagccatctcttggtatacgtgacagggattggttcccggactgcttgtgtataccaaaatccatgcacactcaagttccgcagttggccctgcggacctggtgtgtatgaaagtcagccctctgtatatgcagcttctgagtcccaccaatactggatcggcccttagttgagaaaaaaaatctgcatgttagaggacccatgaagttcacagctgcattgttcaagggtcaactgtaatataaaaataacatttactgctagagttggtactcattctagtgtttatatacttgagtcttagagcaatagccttgggagacaacttccaggaaggtacctgtttgcataccttctcactgcaatccatcagtggctgccaaaagggtatttttgtctcttgaaccagtctcagtacgggatggggaagcctatgtccttcagaattggatggcatagtacacagaagtagacagtacagtagcaagggcatttgcttaaaagcagatagaattgggagcctctacatctttctgtgagaattcagggctcagtttcttaaggtgtaaaatggaaatactactatgtatctggacatattatcttaagaattaaataaaacactgtaccatttcactcaaaaggtgcttgatcctgggtagccatgtagttcacaaatgcagagttcaacagaaaggaaaaatatgcagaagtggtagccttatttgaattatcttctaaccagcagtaagcatactcttagccagtgagaaatactagataatccataccccaaatgcaggagaacacatgagacttacatataacaacacttcattcatgaaagcaatcacaagattagctctgaaaaacggtgattatattacaaacacaaatctaagtatatagataacaatttgtgagtttgcttatttgggaattagtgcctagagataaaggtcagaagcaaaatcacacacccctttggtgaatcaaatcttcctttgaagaattaagtacctcacctaatcagaacagagtccctggtatagccaccgtcatattctgtagtttcttctaatgcttggaaatctagattctgcaaatttaagaaaatatgtcttagtatctgctatactactgtatcattacaaacaataaattgatacatgactttctgcagacacctgctttcttacccggcttccacatataagcaattcaatttcttctggtctgaataagtactttaagggagattcattggtcaccatatgaaaacctctccgaaaagccttgaactgtttttctactgatttattgagaatgtagtcagaataaagattgacaaattcctgtagaaaacattaatcacaagaacttcttataatatgctatgcaaacaaaacacaagttattgggctgcatagctttttaatttttccaagaaaaaaacattcaagaatattcttaaaaattcaattttacacctacaaagaaaactacttcttacaatttcacaattctctgttatggccaatattaaactatgaaaaggccatatacatacaactgtcatacatataaatgtcaattttgacaatgtattaaacagaactgaatataaatgctggagacacagaaaattctttaggttcgctcaactaggtatgcagacagacacatttaaatcatgtacccatctatttataaatgccaccgttttaagagagtataatgtatttgatttaatcaaaccaggaagtcccatgttttctaccatagagtatttggtaagctgcctacggtatccagttcagcaaaaatgtggaactactgactggcacataaactactgtatcaaatcataaaaggaaaatgtgctttgtacccttagtgtgtataatacttaataaaaaaattataccaatataaatatgtttctcaaaggtgtactatatgttcgtcataatgttttccttgtcatgttctgggttattcccattccagacgaacacattttagtcaacagaagcccaaatctaatgtaaagaatacttttcagaaaagtatttacatcacacacaggatatgcatgtgtaaattaaatgtaatttttatttgttctgtgataaagaccttaatcatgaggttcctgtttacagcttaatacaggaaacaccctgcttcttgctttatcctacaaccacacttagctattgactgtctcctgtttcatgtcctctttctctaaaaggggctttagtgcccaactgtgtgctttcataccagcttatattcaagatttagaaaactggactctagcatttacataaacttggttacttgatttgtgtgtttttttttgtacagactgtattagatacttctttaaaaattataagcatacatgctttgaaattattagagacaaaacatgacataaaaacatttattaccttcctgttttcatttgtaattggaattttatcaccattttcctttagatcatacatcattgggttaccaaaaagatctgtctgtgatatctggaaagtgatcatcatgtcgtcttccacattcccttcatactccaataaatcttttaaactctgatacagaacctagcaaccagaaatggtaaattgaggccaccatagaactacaaaatacaacaaataatttatatcactcttcttagaagataacaaaaatcttatcaataaaaattgtaaaaagtgtagaaagtatccttccagtcccccaaatagtttccaacctataaaagaaagactgtcagtcactgtgatgttccattctctgctgagaaactccacaccaccaatttagcaacagatttcacactgtgctctataagaaattctgtggtgtctcaaggtgagggtgggggtggcagcaggcacactcactgtagctaccaagacccttagccagggctgctctgattttacctatctcttaagatttcactaaagcacaaacaaaatgtttagaaacacttctctatggaatcaatctttaaaaagctttgtgctgacagcaatatataaaaatgtccccctttgagtttttaagtgtttgtcgtacttcggtcagattaaaacattatattattgataaaagtatcaacaaagattctaaacaaaaactttaaaattttgatataaataaattgtatttttgcatttaaataaaatctaagagactgaattaaaaaatgacaacttactgggtgagagtctcccaagtcacgaaaagttccttttttccccattagctttctgtagacaaccatgggaaaatgtacatccagtatacagttattgtaaatagccagacccagtactatgccaatcagagtaaactgaccctcagtttcaaaagaagacggattaaaccaaaacaattttgtagattcatcgtatgtgaacatacctgtaagaaatgattttttaaaatacattacttttgtattttattaaggaatgataacacaaatgtaaatttaaaataattatgcatataaaacatttaaaatatatgtaattaggcatgcaacattgatttttattatattagcacttgagaaaacaatgtccacatatatctaactgttataaattggggtgaatagtgatatgtaattttatgaagccaaaggaataaagtagtaagtaatttggtggcatcgggtagaaaaatacgttcattaaattcaagctttctaattttctattgtaacataagaaaagttatattcatactttatccacccatagctgaaaaataaacataaaaaaaccaaaaaatggctatattttgaaagtgtttcatttataaaaatataattacttatatttgtactacacgtactatttttgaaaacaattttttattttttttcttgagatggaatcttgctgtgtcgcccaggctggactggagtggcacgatttcagcttactgcaacctccgcctcctaggttcaagagattctcctgcctcagcctcctgagtagctgagactataggcgtgcatcaccatgcccagctaattttttatttttagtagagaaggggtttcaccatgtttgccaggatggtctccatctcttgacctcgtgatctgcccgcctcagcctcccaaagtgctgggattacaggcgtgagccaccacgcctggcctaaaaaacaatttttaatcacagtaaggaaaggtttgttttttcaaaatcagacaatggtgccatgaaatttttctagcattttcctaataaaatcaaatgatctaaaatacataaacttggataaatctgatgaacttagataaacaaagctatttaatacacattaattatgggctaatatgtaaaaagaatagtagtttagtagtctttcaatttcacatggtcttcactatgcaatcctcaatcacggaggctttttttttttttttttttttttttttgagacagagtctcactctgtcacccaggttggagtgcagtggtgcgaactcggcttactgcagctccacctcccgggttcatgccattctccggcctcagcctccggaatagttgggactacaggcgtctgcgtagaggtcttttttatatcactcattggaaaattggggccgggtgtggtagttcacacctgtaatcccagcactttggggatactgaggcaggcagatcacttgagctcaggagttcaagaccagcctgggcaagatggcgaaaccccatctctacaaaaacacaaaaataagctgggtgtggtagcatgcgcccgtagtctcagctacttgagaggttgatgcatgaggatggtttgagtcttcagcctgggaggtggaggttgcagtgagccaagatagagccactacactccagcctgggcatcagagccagatcctgcctccctccaccaaaaaataagacttaaaaaaaggaaaattggaatctttggttttatctgaatgagtactactaaaaattgatttcttcccttttaaatgactagggaaaagaaattttaattgaatttagaattttttcgttttactaaatgtttagtttctactgtgaaacaatgaaaacatcttaagaattaagtctgaaaaaaaatctgtaatttccaatagaaaagtggagcttagaaatcagaaatcaaattatatagtatataagtattttaacgagagtttttaagaattttaaaatctttgaaaatgttattatcactttaagtataaaaatatggagctttaacatgtttcctcgatcactagatgcatgaattaagcctaggccattttctgaatgcaaaatggtttgaaaattaaacaactcatatttgagtttcatggtttctatctaaacattttttacaggccaagttacaatatccatggaaatgctttcagttataaatatggtattaacaggatcaagaacagctgacaagtaattacaattaataaatttgttcaagttggcaatggtgtgtctaaaaaattaatgaatttgataaaatgtcacaaatgcccttccttggaaccaagagttataagctataagttaatcagaatataactctgaagttccattttaggcacattttctcatgttccagggagaaaagcaccataacctcctgtaaaatattcctttttgatacttctactgccatcacttcagttaccttactggaactgcttaatctatgttttttcttacaagtatttctgcatataatgcagtatgctttatagctaaggtttaacatttctagatacatcaaaagctagagctaaggtttaccaaatttaagaaccttatgaagtttataattttgtatctcaaaaaaagggcacggtcttatgtatctgtgatttacttagaacaaactacatacaaatggcatagttttttagttattaataaaacactagctagactatagataaagggggtgtgtgtgtgtgactaagaacagtaatagaaaggtcaactcaattagaatcaacaggctataacagctcaaatctcaaagctgaagggaaatgacatacattattctacgcatactcctcacaattctgatggtaccttcagtggaaaccttttcctataattgtcatgtactcaattttaaatgtaagaaagttcagttactaagtggttgtatttacagtagaaactaaaccagtagagaattatgcagttaagtagactacccaaaagactgcatcttttccctgttctactttatcacaaaagggcaaaaactaaaattctgatctttcactttcaaatgtccatatcccatcagcctttcccaaactgtgttcaacaacaactcttctggtagggcagaaaaagagttctggagttcaaaaagtttgggggaaacattacctatattaagccccaataaatcccatagcaaataaaccttcatgtgatatcagctagtgtttcttaactttgagcatgacatacttgtgagacagtctctcaacactcttcaaatcattgttctttgaagttcacaggtcaggaaaaccgtgagtttgatgatggttttagacatcaaaaagcaaagaaatccctccaactgttccaacgtaccattctaaagtgctttcgattcaatttaccaaagagataatttccttcattagaatattccttctaagaaatagaataatttgaataaattagtgatacaaatcagtccctaaaacctacaaattcagtcatgatgtgtgattccgggtaatccataccaaatccttcttttgctgctcttcatagctgagaatatttatcaactaagataaacaaataactaactcaaaaagacaatatgacaccataatcacattactaaactatttaccaatatctggattgaagatttcctccacaaccagctgaaaaaattctttggaaacacctccttcatcaactccttgttctccttcaaattccacatacaactgcttcttcaagtctgcaggattttccatagcgatcatctctagctagtgattgaaaagacaaacatgaaaagaagatgactgctagtatcaagacaaaggcaaaataaaaacaaggagtagggttaggaaacaaatacaaatttttgactttttgtatgtaaatggaaacagaaaacaaactgataaaaagccaatgaagacaaagattcagtcttaatgataatgaaaaagacacaaaagataccggcatagtaaaaagcttacgaactttactgatttattacaaaattaacatacagttaattaagattttattacttgtgtgttaacaagtctggactacacagttaggacatggaaaagcagctaaatactttcagcaaaaacaatggagtagaagtctgacctcaaaattgtccattagtagtcctttatttttattagaatagaaactcaagagttaagtcttaatatctactgtcataagtaaaatatttcaattaagaaaagtacactgaatagtaaagcagtttatgatctctcacaataggacttagtacaaattaccaccttttaatgggttagaacccatcttatattcacattttcttaaaagtaggtgagacataaccttactcatgtccttacttttttttttttttgggatgaagtctcactctgttgcccaggctggagtgcagtggcgcggtatcagctcactgcaacctctgcctcctgggttcaagtgattctcctgcctcagcctcctgagtagctgggattacaggcaggtgccactacacctggctacattttttatttttagtagagacggggtttcaccatgttggtcaggctggtctcgaactcctgacctcatgatcctcccaccttggcctcccaaagtgctgggattacaggcgtgagccaccgcacccggcccttactcttaaattgtaagttatcaaactttagtgtctagcattttctcaactataaatcttttaccaaatattcttgtgtacctatagaattatgaatatgcagtaattaacctcattgagattaatcacaaaatcaacactagcaatattaactgtttatactgcattttattttatgtatctaaaatttactaacagtacgactgtatccagtacatggacagatactgtatccagtatccatcatatctcctaacttgccttcaaacatctgttggctggttaaaaaattttaatcttggagatgaaaatttaccaaaacaggatattaaatgtgttcaggttattccagctattccaaacagagttttaaaaatggttttgaaaaatgcaataatcattgaaataactgtaatacagcacaatagtagttaaggtaataatactcatttggacaatctagtctgtctataaaaaataaaatctcataaattaacgcatcaggtcaggttgccctagagcattgtttttttcaaacttgtcacctgcaactcattagtgggtagtctaatccatttagtggtttgcaatcagcaatgggaaaatcagaatgcattccacaaagtaatggacacctactgttttgtgaaacttctgtttcaattagatatcagacggatatgtatgtactgggatgctatgtaaaatactagggattgcagtcaaagagtttgacaaaactagctgaaattatcttctgggtatcttccaactttagggtcccattctgtgaatttagtctttagatttaaataatgtctgttcttgttcaacacccatctctaatatttacaaaatcatttttaggccacacagtttgagactgttttgttgtggaaagatcaagagtcagtcagaatacaccttactagtcccacctctcacttaccataacttttaacctttaaactttagcaagcgattcaattaagcctcagtttcctcaacatactataagttgtgaaggcttattaagaatatatgagaaagagtgttaccttttaaaacaattttgctctttgaacaaaagatttgcaattttgtgtccccaaaggaacttgatatagactagttccaagatctagagtcaaacaaatgtagatgtgaaaataaccttggagaaaaaaaaatagttccagttggaaacctgtttcaagctacggagtatatagaattctgaggagactaaaattagaattaacatcttagctcaaatgtgggaccaggccaacattccatattgccatgtaatccattctgagtttccttatgccagttcccaactggctagtgttaaagatgtaagtcagtgtttatatgtacctttacatccaaaggtatacttgcttttatcaaatataatgtattccaaagtggaaaaaaaaaaaaagattatctggtatttagactatgcattctacagcttttccccactaacattcatacatgagagctgactcctcatcatcaatgtaaaaccttttaaaggacgtggtggagaatttctacaggattgagaagccctgtgttctacctagtctcagctctacctaagacatgtcaaatgacaactgaagcaaatttatctttattatccataagatgttacatgcctgtccacttccactgatctctattctatgctctccaccttggtgccaaaagaatgtaatgcaatgcaatatgttctattgtaaatgtaaacatacaactttacctatttcatctgtaaaataagcataatactatagcaataaattaatgtttgaactgcttagattccctgcataaagttagtgtttaaaagtactagctgttgttgctgttattttattggttctaaaactctcttcaatgatgaccaataattttttttttaggattatgagtgatttttattttccttattcttttccatatttttccattttttacaacaaatacatttttcagagtcagaatatgttcgaatataaatatgtaaagagagtaatttgaaaagtagttggtaactgaattctgtagacaaaaattttgttattacctattttagattaccattctgctacacataagtgatttcataaaatactgtgccacttaaaaataaaggccgggtgccgtggctcacacctgtaatcccaccactttgggagaccaaggcaagcagattgcttgagcccagcagtttgagaccagcctgggcaacatgacgaaaccttgtttctacaaaaaactcaaaaaaaaaaaaaaaaaaaaattagtggggagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtaagtcagaagttgttttaaatgcattagaatatttgaaatttggaagactttgtcaaaacattctaaaaaggagaatgtgcatgcatgcctgaatttatttggtatacagatgtgaatttttaggtatttttaaaagtacagcgtatgttgtatttatttaatatggacactagcaagagacagagattactggggaaaaataaacaaaaacatcctggatataatcatagctacctcttcactgcgtaacttcctcctctttaggactcttgacttcatcaattgctggataaaatgatttttaatttctgaactttttaattggccatgatgaagaaatcctagggtgttcatttttttaaaaaatctgacctgatatcaaagtatttgcagaatacctagcaggatgacatcttaatatcaaaatatggtattactagacttacaggaatcaaaaggaaaacctcctcacttaaaatcttagtttcctgagctattacatcaaacccattcataatttaaaaaaaaaaaaatctttaattgcatgaatatttaagtagaagcagtactcagataagagagacctctaacacttaagaatgcctgggatttctaagaaaggctagcttcaactacttcagtcaacttgaggcttaaactattgcctgagatttctaggttatccagattaattttttcatgttcactataaacacatgaagaaaagtctgttacatctcaaatgtagtttaaatgtttgggtaataccaaatcacataatcacgtatgtccatgagacctggaatcctgacttctacttccaattctgccattaatttatgtaggctagaatctcttttagatttcattttcctcacatgtaatactaagaagtttgatgtttcattgtcttaaattattatataatgctgaggatctatgtatatataggcttcattctctcattcagtttctgagaaattactttgagggcataaactaagaatatttcttggtttcattttttatttcaattagaataaatcacaagaacaatggaaattacatgttaaccacaatatactgtatgtgtaagataaaattaaatatacctagagcagcacagaataatcttatttttaaagctctgtgagtcaatgaatgaataaaagaattaagttcgtgtttcaataataagagtgttcaccaacgctggaagctgggagctgaaaatgctggaagctgggttagactgggctattagaaaccagatgaaaagggccagtgactttcagaggggattttgcagaacctcctggtagtggggctttttatttgtgccaatcacctttatttgtgctaattcctatttttgaacttccctattcaattccacatctcagccattccttttggtttttaggtatttatgtgaaattctagaactccctgactaattggaaccaagtttcacaccaccatcatcctctattccaagcttgctgcccccatgatcctcttaaaaatctgagtttccgaaagacacatacttgtatatcaaaatggccttcctttctctatgtatgctcacatacatacatacataaacatacatgcacaaacaccccaacccaagatgtaccaaaagccaccttcccaaatattggagtctggctttatcaaaatatctgtggagtattaccagaaatacagattcataggctctacaatacagcttctaatctaaacctcttaaaggatagggccctggatttttttttttttagaacaattttcacgttcagatgtgaaggcagtttgggagacctcatgatggcaatactatgttcttccataaacttataacctctatcttctcctttaagaagtaatttaaaaaatcttaatacatactatccttggaagtgcttcatctaagaaaaatgagaaattatctacttgtaaaagaacacgcaaatgggtaaatatgtaaaaacctcatcacatttaggagtgtcttcattcaatgaaaggtgaagtctaagctcatgtttatcactgtactgttttctaaggaacaataacaaaaagtactgaaagtcagtcctaggggaactatggcagtaagctaaacaggggtagggtgggggtgttcttaggcagttctaaagtgtttgtgaagagacaatttatattctattgattctaaaattcacttttcttttttcacattatctgtgaaatcagattataccatacaaatgacagcatcttacaatgaattgctggtatttttctgtcttagcagtaataaaattatagtgttttctacaatcagagattaaaatactacaaacatgaattcttctcttgtcatcaaagacaatttctctaaaaacctcaggaaaaaagctgctagtctgctttgaatatcacaatatacaaaagcaatgaatatatttttcttttttaaaaaaatccataattattaattcaagttaccactcctcaacagaaaacatacaagagtctcatatatgaagtcactattttctgggcttgatttctaaactaaggagtgaactcttctttcagctcttaaagccgaagatcccataattttatttatcaatattaagcttaccacaaagtttctcatttcttcttttctacccaacgctgctatacagttccaaaattagcaagtcataaaaaagtggccaatagtttgttcactgtgatatataagaatgaggcttaaaaagcagagattcttgggaaataaggtcttgaaaaactcatcactacttttgagctttcacatgagagaataatctttttttttttttttttttttttttgagacggagtctcgctctgtcgcccaggctggagtgcagtggcgcgatctcggctcactgcaagccccgcctcccgggttcacgccattctcctgcctcagcctcccgagtagctgggactacaggcgcccacaaccgcgcccggctaattttttgtatttttagtagagacggggtttcaccgtggtcttgatctcctgaccttgtgatccgcccgcctcggcctcccaaagtgctgggattacaggcgtgagccaccgcgcccggcgagagaataatcttaaaccactttctactatagaccttctactatgtgttactaaaatatgtggctttatcataatcatcacctgctgtgaatacttagttcaaaaaattacgcaggttatcaattttacttctaagacctattttgatgctggtttttccagtgttttcacattctgttatttaaaaaaaaaaaaaaaaaaaaaaagaaagaaaaggaagaagagaaagcaagggagaaagttagttaagagtaaaatctgcttagtgggagcatttagagtccctaagaagcttctcagtgagcatcatctctttctactttaacagtttattaaactgcctaacacacatgacttctgaagtgaactgcttttgtgggcaggcaatattcaagtacatatactatctagtgaatcctgatttataataggccacaccatattatctagttttgatataattaagcagaacttgctaaaaaaaaaaaaaaaaaaagttaccataattaaagagctcacagttaattttatactaacacctgagaaggctttaaaagcggttgtttccttaaaattctagaatagaatttaagaaatagaataaagtatacaccaagtacttaacttttgttgtttgttaggcttgctttactagagaaaaaaacggggggactgaggaaaataagactgagtagacttctgagcagaagacagataaggaaggtagacaattttttgaaccctggaatgaatcttacagtgtaatttcattgcttttaaaggctagacatagcttttgatgaagacagcagaagggatctcacctcaagaagccaaacataaagtatgtagcttcggcatttgcagttctgctccaacaatggatagtcatagacagacctcaacatacctttcataaaacatcactcacattcttataaaataccctatcattctgctaaactatgtaaagcaaggtgctggctgccttatgatcagtcgttaagtgtattaattattcatgtgtctcaaaactatgtaagtgaaataaaaagggtaccagaaagcaagcaataataatgacttcaggcagttaaagcccccttttgtctctgctagaaaaccacccgagttgcttaaataatgcagaatctttctccaccactataaacatatctgacattaaaaacaaaaacaaaaacagtaacaaagaaaaaaacacacaaaatctctgcaatttgtaatttctgagatgtcaactttttccactgggctatagttttatgaattctcaaatttagacaattctaaaactaaaatttagacattctaaaactaaaatacattttaaagtaaaaatcacatttcctagttgtgtcagacaactttctctactagtatactatagtattattaactaccttaattttggttgacattaaattttacttgaagatgataaaaaagcagcaatgacagggatacctaatactagaaatacaataaaactctgagacaatacacctgtgacaaatgtaaattctggtaaaatgtgactgacaattggtttctgtcttctggccactcttatattcttaaatagatacactaaaaataatcttttgtggagaaaagcaaagcaacaaatggcaaccccatctggaaaaccaggaagttaagacgagtacctgagtttccagtatttccctgctcgatctccctgcacttgatgttacaggcaccaccacgaatccccaaatttttggaatagctgctgttttccagaagttccaagacccagagttgtctctatgaatttttaagtgggaagaaactaccacagccaggcagtgccgtccatacagggatattctaagtggcccagcaggactcaactcttactggcaacaggcgctggtctgccatggtcacttcatcaagttcacaataaaacaactctgaattttacatgatggaattttttggacactacctataattttatggtatagttttactgtaccatttctcccagttcaagacttcacatccacacttattactgggtatctccacatttctcttgttctggtctttgcccaacactctattctcttctgaatgaaagaaactttggatctagtattcaagatttagaaaacccactctttttcaaagatagagtgagcattatataatacaaccgatactttgtagaaaacatctataaacttggacaggaacaacaaagtataatacttatatctaagatcagaaatgtccatgtgttcctatgctatatggtatttttttcagtcacttttaaaatgaattcactgaactgtatcatgatatccccattactaggtttttaatctagcagcccaacttacccggacaagtgcatcatctatgatatggtcacgtctaactttgagtctcaaatatggattcaactgctgtccttgaactaagctgtagagaacagtgattcttcgttcactgtacatgcgaattctattgtcataatataatcccaaattctttgtgacagcatttaatataaagggacatgtcataaaagagaatttgttctctgtttctactttgaaaaaagtataatctttatccatttctagaacctcattcagtggttcattaataaactcttcaaaagggataagtggttttcgacaatccagggttttaacaccaagttcagtttccagggggtccactcgaggacctttcttgtttcttctttcttctcccaaaagctcctgaagtgtcagctcactggattcagggatgggctcttcatcatcttcttcattgtgatttgtgtccacttcccctcccactacatttgcatagtaaaccattttcaagcacttcgaagcagcaacaatggcatcatcatcgttcactagatttcgactgttaaattcattgcttatgactttgtaagtaataagttgctgaaatgtctccatcattctccgaatctggtctgcattgtatttagaccacagtctgatcagttttccttgggctgcaaggggtagcttgctcattgctttgcaaaataatggcaaagccatttccagatattcaggactgtggagatttctattctccattacgataatgaacaaattcagataattaggatctcgagagtatacattgtgatacgtcaagtcacattccacgttaggtgacaaatatacaagtgcattgagaaaggcagtttcaattttttcattagacagcaatctggtgtagacccttctaatggcatcaatatccacagacacatcatcagggcctactttctgcaaattgttgtctccctgtgagctatcacctatccttgaggaagatgcttctgagtcttcttccatagcagcagcagaacatgcagctttttccttttcatcttcatccttgtcttcatcttttgcttgaagagatttcagttcttccttggtatgttgtttaactttccggaagctctgtaccaatgcctcagcactagaaaaaactcttccaataacacgaattaaaggggaataatcctctctttctctacataattcaagaatttcatataccttctcttctgttaagtaagtcacatctagaaaatcagaggaaaaaagagaacatttattttcataatatgcatgtttaccctgttgcaaaaagttctaataaaagtaaaacagccaaacattgtagtctcaacatcatttatgatatacaactctaaaagtatctaatacttagattcagcaaacaaaattcaatgcttacctatttttttcaatgaactacctacaccaatgacctcacccatgcttttacattctttcaacaatgcataactcttaatgagatcaggagagtttaaactttctttataatcaagatatctattaatgtatagctttatttataaatatgaaccaatatgtcatatactgattaatcataatacagctcttaaaacctcactgtagaacagaaatactactaatcttctgagagttttcttgtttcagtactccgttctcaaaagactgagaaggcaaagtcttaaaagaaaggttccttcagcatctatgtatgtattaaaagaaaactggttcattttgggtcttcctagtttgttccagggtagtcattctgtgagtgattgagaagaatataccatttctcatcagctcttgagcagaaactgctttctgcagccagcaatcaggttagactaagtctcatagagtgacagaaaatagtttttgagcaatgaaaacagtgcgaagaaggcaacttatgagctggcaagcactgcagagactatgtagtcatcaaatctatttcctcttttcctgggcacagagttggaccacatttcccaactttttgagataagtgttattttcaggccaatgctttcccccttctggctaacaggatgaaagatattttattttacaggtaaaaacaaatgatatattttgtgtactgaccaacataatactgagaatagtcttaattctccctttcatcaataaagtgacatacttatcatcatcagattaactacttaaggtgttaattttagaggcacacaatcctacctccattgtgccaaacatacctttatacatgtactatgcaacatgtagaatttttaatgactcccacctctgctataatatatctgtttcacaatgaaagacaatataaaatgtaagtgatcattgaatggtctccaaaaattgaaccacaaaaataccaaattttatcatactaaggatctgatctgtggccaagctacaagagtgtcaacacttgcagtttcttttatgggccttaactctttaagaactaattctcaggtttgttctattaagaatatataagcatcttttgctaaacatcagtaaccttttccccaaaagcgtaaaaccactggaagtctatttctcattattttcattgaaaatttttataataccttcttccaagacaatgcaaaacccctatctaatttcccaaaatgtaacagaaaattaagacataaaacactttgcttcctgagcaagtcataagcttaacaaagacttgctttgcatgcagtaatatggcctgtcctagggatcacgattctagactcacatgtcctttgttgatatgtcatgctttcggaacatcttcaagtgattctgacagtctactaatcctatatagaatgtacctatactttttccatgtagagttttttgttgtggttgctgttgttgtttgagatggagtctcgctctgtcgccaggctagactggagtggcacgatctcggctcactgcaacctctgcctcctggattcaagcgattctcctacctcagcctcccgagaagctgggactacaggtgcacaccaccacagccggctaatttttttgtatttttagtagacacggggtttcaccatgttgactgggctggtctcatctcttgacctcgtgattcgcccgccttggcctcccaaagtgctgggattacaggcatgagccaccatgcctggcctgtagtgtttaatatgttaaactgaatttttcagatatatagataaaaattagtcaaaaaacactgtaattagatatgaacattcataaagtttggtttactgatagaggtgttctactgagaatatattaaataagacattttttgtaagatttcttgtgataaatgtgtccctgaaaatactcaatcttttaaattctgcacttaaaaaccttttacacaacaagagtttggtgcagactacttaatacttacgcaactttgtgattagtgttaataaacataattaataatcaaaataagagtactagtgcagagaaagcatttctaatttctaatatatgatagtaactgtaaaacactgcaaaaacaaaaacaaaaacaaaacagtaaagaacagggaatagtaccagtagcagattagaaagcaggaaaaaggaaaggtcaaaactgctaactaatgcagacttcagcaaaaagaggtgggggcataaagaccggataaagccacacaataagcatctctaagatggagcatgtggccaaaagagcagatgagtacattcctcatgtatcacaccccccccagctggctgcattccactgtgccagcactctgcgttcagttactggtactctgtggtgcacacttactggagaactgtgtacaataaagtcaatgcagcttccacattatactgacacactatatatatagacatttacctatttttccacagtgtgtgagctaattcatgaaacagaactatacactctgaagcaacaaagttgtgtaaagtgacgaaaataattctattgtggaaacagtagaggttataacacaatgccacttcattaattctttcaaacttgattcagatgatgttactgaaagttttagaggcaaatgcctctaaaattctgtcacttacacgtcataaacaaaaagctttctctcttaaaatacaattgcctctgcgtgtgtatgggggtgggggtgcaggggcgctaagccctggcagtcattcaaaaatttgattaccgtgttactaattacattcactgaggaaaataacttggagttttagtattagcgacaaggtaatcgaatcctgaattttggacacaggaccatttaaaaaacaaaagacctgagtgaagattgtcattggtaggtcaccacccttggcagcatgactgtaccaaatgtttgtgaggagagtgagaagcatatatttgaaggaaatgtagaattctcacataactatcacaaaattttgtcttgccttctaaaatggaaaaaacccactgcttcctcttcctacttctttcatcacatcatcctgaggttccagaactcatgccagatactgagtccagttattctataacttaaatagatgttgtggcctagttttggagattaactatcaattaatacttttttccctaagaattttaaaaagttcaaatccatctattaacaaatgaacttttggcatatgatctgcttctaattagcaacgattaaacctgtaaaatgtagttattattcctgtcctttaccaaaacaaaaaattggttctacggtatcaaaatgtcttaatgtcacataagaaaaaacaaataaaaactcatacatttaaatctcccacatggttttcagccaacaattctcaattaaaaataaaacatcttacctttaaaatcaattctagtgcctttcttgttcatttttatctcagagcaggagttgttgggggcacctttcgagttctcaaggtaagctgagcttgctcctttcttggagggatgaggatcacagagttttgcattaatcttataaagctcgagggctttaatagctgctgcattattatccatacgaagaaaagttggacaggaagcacaaaactcattcgtgcaggcttcatttccacagccctcagttaactggtggtagtagcgttctattagatgctttgcagctgctcgcttcctgtaccaaacagtcaaacaataagcacagtgattagtatagctgtcatgtacaaagcccaacagatcatcaaggcaaaagttagtcaagcactgaagtgattaacctgtgtgcgaagatgagaagtagaaaatggagatgcactatttaccaacaacccctgactagtgaaatagctaataaatattttctaggatattatgataaagaatgtcaatgcttactgactgcattaacagagtatacactcctttggtttaaaaggggggaggggggctcgtctgatggtatatgtgcttaagttgtttagtacaacagctgaaaaatcaccaggtttacagctaagagttttaggattctatcattttaaaaattagcattaggaaaatccagttttcctttacataatcactatttcatttttaacagtttgtaaacatttgacttacagttaacacagaatatctatctggaataaaaactatttttcccaattatcaaccacatgggagacttaaaaataaatttgtaagtggaatatccaaagctagtgttacactgaaagaaagtggctgcagcctgagtgaggtagatcatgactgtaatcaatcccataactgcgggaggctgaggcacgcagactacttgagcccaggaggtcaacaccagcttgggcaacctagtgaggctactctctacaaagtgttatttttttttaaattagccaggtgtggtggcatgcactgtagtcccagctacttgggaggctgaggtgagaggatcacttgagcctgaaagtcaaggctgccataagccgaaattctaccactgcactccagcctgggcaagagctagactttgtctcaaaaaaaaaaaaaaaaaaaaaaaaaaggaaaataaaaaagaaaaagaggctccaaagtatataatcttaaatctaaaacttgtcactaaacctcctccttagttccacattacaagatggagtattttaagttgcatcactcaaaatcttatattccttttactctgtgaacttaaagtacacagattaatgtcctatttcagctgttacaagagagctaccaaaactgaggaaggaattatgtgatcaagtaagaagttagatgacattatctctatattcaacactaaagagtctgtacttctactaactgatgatgagaacaccataatttcagtagaataaactactggatccaaagaaacgtaagtcatagctattccttttggtcccaaattcacaagtatggaaataaaaactacgaagaatcaaaattataagaaaaataattcagctaattttcaaaacattcacagaattatcttactaacatgtaggactaaatgaccaatggcagagaatttacatcttgctaatcataagaaactcagtaacaagacagcaagtaagtgaagagacaaatgagatccaattttgtctcaaaagaaagactttgactgtctaaactatgcaggtaggtgacaaaaagtgataattcacacagattcaattcattctggtgcttatattttttcaaatgttccatgcaaatttaccactcactgcatgcaaacagagaaaaaagaaaacccacaaagcacacgtaaaaattgcataaacatgacttagagacattttgttatctatgaagctataaacaacccaacctgaaaattaaaaactgttatcacagatttatcactatgcaaaatatgaaagtgaaaacatgtaaaaataaaaggggaatggagaatccagaaactttaaaacatacattgttagtcttcagtaaagaaagggagataatgtcatgttctcctaaactacagtgacttccctggtgaaaatgtaaacaggtatttcctttctggaggaaaatagtgaatatgtatcgaaagtcttaaaaacatgaataccacatgaatgagatcctacttgtggaaaacaatttgacaattttacaaaaatgcagtttccatatctgaataaaatcaacatgtttaataaaagattacttaaatgaactgataataggtcacacaataaaataaaaactatcaagattgaatctgacaaggaactgcctagtcttcctgatatatcactaactgacaaaagtcagttacaaggtagcaggtgtaggatgaacccattgttatttcaaagcattaatagcattttctctggacgatgtgattaaattagttttaaaacttctttcatcttttgatttcttatttattctttccataataaggatgctacttgcatattaaaaattaataactataaggggaaaacaacagttttaaaacttcatatacatgatttgaatggccccaagatgtattaaattgtctctgatttttaaaaaaattataaaagtcaaaatactaagatagatatttttaatgtgagcttttatactaaaataacttccccaaaacctgtcagatacatagtacttctttacatactacataataggagagtgatcagcacaaacagaatgagactgaaaaatcagaagacctgcattaagtgtcatccttctgtccctaagtagctgtaggatcctagggaaataactgtctgggcctcagttttcccagctttatgagtcccttcagttctaattttaagttattttatgtaatagggaggtgaacaagaaaccagtatttgttggatgcctgataacatattacacacactgcggggcactttgacataggttatctcatttgagtatcatgatactgaggattatcttcagtccacagccaaagagagaaatagaactggagtcaaatcaccaaacccagatctcaaagaaagtacacaaccaagacaagaataggagtccaggagtctttcagcttcagagtctaagtcattttgactatactgttttgcagaaggtgattcatttccaaacaattattttttaacatgagtaatactgaagaattctatggaaaaaaaatctcataactaatgtgcaactgggaaaaaaaaactgaagaatcataatgtgaacctcacatttatgcatatatctgataccacaaaggtagaccaaatttcttgaggaaatggaaccaccacattctgcaaagctaatttatctctaattttctgaggacctatgtgctatgcattttatagacattctcacgttagaggggaataaaccttaacagttaagagcttgcattctgaggccagatgcccaagttcacatgatggctctacctcttaattaactatgtgaccctgaatgagttacctgacctttctgtacgtcagtttcctcataatttaagtggtagtatctacgagcattctcatgatgagagtattattattcttcacattatcgattgtgagaaaattaaatgtgttaatatatataaagtgctcagaacactgcctggcatactaagcactatgaaagtgttagctactactactattgttgtaattgttatcaccctcacaagtgtatgagttagcactataaaccttcattctgctgatgctcagagaaattacatcaataagtcattcatctaataagagatctgaactcagctactaaatttgagcttttaataactattaagaggaggatatgaaagtagacccctgtatttgatctgcctttctgtgccaagttaacaaacagcagctacactgatgagacaggactaaaggaagccaggtcagaaactccatgttaatggtggaatcaactatattaagcattcttctttttcctcactccaatgacaccttaatttatctgacctcatctgtattactatctaatttagggtatgtaaaaggcatacaaaatttagagcacataaaggggcctctatgttggaaaagtatacattaaacgactttttggtatagttcctgtgcaaggttaatccttgtaccatatggttcaccaaatcatagctcatgagtcaaaccaagttcatcacctatttttgtatgtctctcaagcttagaatattgtacatattttaatggctggaaaaagtttaaaaaagagtattttgtgatgtgaaaattatatgaaattcaagtttcagtgtccatcaagtgtactggaacatacccaagttcatttgtttataaatatactatatatgatatgctttggctctgtgtcctcacccaaatctcatcttgaattgtactcccttaattctcatgtgttgtgggagtgaccgggtgggagataacttgaatcatgggggcagtttcccacatgctgttcttgtggtagtaagtctcacgagatctgacggctttatcgggggtttccgcttttgcatccttctcattttctcttgtcagtgccatgcaagaagtgcctgtcaccttcgccatgattctgaagccttcccagccatgtggaactgtaagtccaattaaacctcttttttttccccagtctcaggtatgtctttatcagcagcgtgaaaatggactaatacaatatactatatagtttatggctgtttttcatactacaatggcagagttgagtattctaggcctgcaaaacctaaaacaaataccacctgccttttaaagaaaatgtttgccaacccttaatttaggatgttatttatctctgccctccagtgaccctgccatctaatcatttggtctcttaactctctctttcccctcagcaaataagtaaaataaaaggtgtacctttccccaagtattattaaagaaaagaggagaagagggagagagggaaagagggaaaaagaaagtaaggaaaaggagaggatgcaaaagaaaaagaaggaaagaaaggaatttccctgatgaggtccctttagcaacaccttatcagctgctcataatcaaaattcctggaagaggaactatagctttacttgccataatttcttcacattaccttgacttttctttttactcaaaaaagtatgttataatgtgttgatttttaaaataaaaaaaacttttcttagtcagcaatgaaggtcaagcgagaccttctagtaagtcttgtaaagttagacacatgaaaatacttatccatttcaaacagacaatactttccaatttttatttctatgactgaattagtgggacagtgctacaaacagaagtcctatggaataagtcatatttggaaggtcagtttaccctagacaacttgacagcaatcagtttaaaaatggtttcacctagagggctgtgtactgatgttagcaattaactttgaaaggcataaaaattaagatggactgatgatacaaggatggttataagataaagcaatgtaaatattaatggcagaatctaggtgacaggcatatgcgtgtcagctataaaatctgtgttcaacattttttagttcccacatatcagtgagaacatgtgatatttgtctttctgtgtctggcttagttcactaaaaaaatgaatttacaggacaattggaatataagcaatgaatacaagcactaagaagatgaggccatagacacagctgccagaaagtgaagatgtgacagtgaacactgaacaaataagattagaattacaattagaatcagaaatgacaaaagagaaatatgaactgtgagatgcaatataaaaactgatggtgagtaaagcaaagaataaaaaataaaaagggaaagattaaaaggaaaacgtgactataagtagagtgacctttatatttacagaaggtacagcagaatgaacatgtgagaagtctaaaaaacagatataaaatagaaacaactcaaggcttatataattagtctataaagctaagaaacactgcttagtaatttctcgtaagtggagcctctttattctttctgggatgttgcaaaactccattccatctcaaagttatttttaatgtaaaaatttgtaagagtgagcaatggtatcctaaatagttctaggccttgtagaaatagattgtaagagacatctgtgacatagctatattcagtacgatgtagggtctgttacaatgggatgaaatgaatttagattatttcaagactaaacctacaattgtgaactctttagtaccatgaaccaaacaaaaacctattaaatatagaacaagacgattttcatgaaaaaataaacacaaacaaatcagtattttcaagtgtttgaaatataggttaacctttaagaactgttttattcatttttatagtctcaatgtccagaatgcttgatatatgattaaaaaaaagtaaaattatacaactaaatatttatataattcatctgtaaaatgaaaatctgttttaacgtgtcatatttcacagttaggagaataaaaacctcaaatcaacaaattaactttacatcttatagaattaggaaatgaagaacaaattagactcaaacttaccaaaaaaaaaaaaaaaaaaggaaataacaaattacagttaaacaaaatagagaaaaatagaaaatttttgcaatagaaaaaaaaaaatcaacaaaattaggagtagctgtttcattgaaaagatcaacaaaattggcaaattcttagactaagaaatgaagagaatagacacaaacagcaaaaattggaaattagaaaggagatacaacaactgctgccgcagaaataaataggaccataaaagactaatatgaacaactatgccccaacaaatttgataacctctgagaatggatagacacatcaaacccaccaagactgagtcacaaatacatacaacttctgaatgtacctataactatcagagattgaatcagtaactgtccaacaataccagggcttcactgaaaactctaccaaacattactctttgaaaaaactaaagaggacagaacactttcaaaatcattatgattttgataatcatagtaatgctaagtaagcattacttagatatcaaaatcagacaaatttactacaagaaaaaagaatccctaataaatactgatgcaaaaaaaatcaacaaaataccaagaaacagaattcaacaatgcattaaaaagaacatccttttgtgatttaaaaaaaggccagatatggtggcttgtgcctgtaatcccagcactttaggagggcaaggtgggcggatcacctgaggtcaggagtgtgagaccagcctggccacacagtgaaaccccatccctactaaaaatacaaaagctagctacgcacggtggtgggcacctgtaatctcagctactcgggagactgaggcaggagaatcacttgaacccgggaggcagagctggcagtgagctgagattgcatcattgcactccagcctgggtgacaagagcaagattctgtctcaaaaataaaaacaaaaacactcaatttgctagaaagatatggaaattacttcaaaataatgaaggccatatatagaaagaccacagctaatgttattcaatgatgaaacaccgaaagttttccctctaagatcacaaacggaacaagaatgcacacattcaccacttctactcaacatactatcagaagtcctgccagagtcagcaattgggcaagaaaaagaaataaaaggtattaaatgagaaaagtaagaagtaaaattacttctgttagcaaatgacatgatcttatacgttgaaaactctagcccaccaaaaagaaaaaaaactgttagaataaaggatacaggatataaaaataaagttacaggatataataataaagttacaggatataaaaaccaacattaagagttgcatttctaaatactaaaaatgaagaatccaaaaaggaaattaatttttaaaatccatttaaaatgaaatcaaagagtaaaatacttagggaatattttcaacaaggaaatgaaagacacatacattgaaaattatacaacataggccaggcgcagtggctcacgcctgtaatcccagcagtttgggaggccaaggtggggggatcacgaggtcaagagattgagaccatcctggccaacatggtgaaatcctgtctctactaaaaatacaaaataaattagccgggcttggtggcacacgcctataatcccagcaactcgggaggctgaggcaggagtatcacttgaatccgggaggcagaggttgcagtgagccgagatcgcgccactccactccagcctggtgacagagtgagactctgtcccttctcccccgcccaaaaaaaaaaaaattatacaacaatgctgaaagaaattgaagataatataaataaatggaaagacatccaagtttatgaattggaagatttagtattgttaagatggcaatactactgaaagcaatctgcagattcaaagcaatccctatcaaaatcccaatggcattttctacagaaatagaaaaaaaaaaaaatcttaaaattattacggaatcttgaaggaccctgaatagccgtaacaatctggacaaaaaacaaagctagaggcctcccattccctgatttctaaagatattgcaaagctacagtaatcaaaacactatggtgctggcataaagacagatatacagaccaactgagcagaagagagaacacagaaatagggaaaagaggttcttcaacaaactgtgttgggaaatctgaaatctaacatgcaaaagaatgaagttggagccttatcttacaccatatacaaaaataagctcaagatggattacagacctaaacttacaacatcaaactataaaactactacagaaaacatagagaaaaagcttcatgacattggacttggcaatgatttcttgaatagatcaccaaaagcacaagcaaccaaagcaaaaatagacaaaccggggatacataaactcaaaaatttctgcaaagcaaacagtaaacagagtaaaatggcaacctacaaaacaggagaaaatatttccataccatgtatctgttatttggttaatattcagaatatacaagtaactcctacaattcaacaacaaaaaatctagttaaaaagtagacaaaagacttgaatagtcatttttccaaagaatgtatacaaatggccaataagcccatgaaaagatgctcaacatcactgatcagtagggaaatgtgaatctaccatctgaaaccattaggatgaccaccatcaaaaaaacagaaaataagtgttggtgaagatatggagaaactggaacccttacgcaccattggtgaaaacgtaaaatggtgccaggcactatgaaaacaacatgaagatccctcaaaaaatttaaaatagaactacctccagttccacatataaagagcttggaagtcaccactccattctaacaggtaaaaaatgacaaactgaaaaacaatcaaatctgagataggataagtgaggtcacagggcaaataactgcctgtaagtgagagcgaaggacaggtgaacacatagcatcaccatttatctgagatgaaaaacacaagcagaaacctccacagggtaggaaatcctgaagtgtaatggacaaattgatgaaggctcagtgtggacaactccgaaagctaaaaactccacagttacccaattatagggggacccctacaattttctaagttttacatccaggcaattgaccagcttctcacagtcaatataggagaaaaattctcaaccctcagcaggggagacaaagagaaacgattttcaagtacaccacagtattctggtcttaacaaggtttgtcctcaggagaaactaaccagagcctgacctgctgatgttgtagcaaagccaaaatgatgtgggggaagagaaataacccaactccacgccattatagctatcttgttctatctaagggaatgggggggtggtgtgggactgagaaacacttgtgaagttcacagtccagaggcataagctcactaaaagactgacctaatcataagactacagaactcttctcctcttcctacaccttacaaccacattactaaaggttcatttacaacagttccttttacctagtacatcgtgtccaagctatcaataaaaaaattacagggcataataaaaggtaaaaaacaagcatcaggaccaaattcagcagggatttggaattatcaaactgggaatctaaaacaaccatgattaatatgctaagggccctaacgaattgactaaacaacacgttaaaaaaaaaaaaaaggagagatgaaaatcctaagaatgaaccaaaaggaaatgctagagataatacaaaaacaaaaacaaaaaacagaacactgtaagagaaatgaagaatgcctttgatgggcttattagtaggctgggcatggatgaagaatctctgagcttgaaaatacatgccaaaaaaactacatctgggcataaaacgttgttaactacagaaattcaaggataagaaaaaaatctgaagtaagccagagggaaaaaaatcactttacccatagaggaaaaaaagaaaaaaaaagaaaaaatacatgtgacttcctacaagaaaaagagtggggtgaaatatttacagtgttgagagaaaaaattcataaacgaagcattctaccttgtgagattattactcaaaagttaactggaaatctacatatacagagcataaaaagaaggaaacacggaaagtaaaataaaaccttttatttttcttatacttaattatctaacaaataagaatttgttcaaaataatgtcaacaattgtgcttacgcatacagacgctcctaaacttacttattgggttgtgtcccgctaatgccattataaagtgaaaatatcacgaaaacacaacttatccaaatttgtgggatacagatacagtgaaagcagtacttagaaagaaacatacaacactgatgcatttattagaaaagaatgatctaggccaggcgtggtggctcacgcctgtaatcccatcactctggggggctgaggtgggtggatcacgaggtctggagttcaagaccatcctggctaacacactgaaaccccgtctctactaaaaatacaaaaaaaaaaatcagccgggcgcggtggcaggtgcctgtagtcccatctactcgggaggctgaggcaggagaatggtgtgaacccgggaggcagagcttgcagtgagccgagattgtgccactgcacttaagcctgggcaataaagcgtgactccgtctcaaaaaaaaaaaaaaaaaaaaagaaacaaaaaaacaaataagaaagaaagaaaagaatgatctaaaaatcaattatctgagctaccaccttatgaaactagaagaagcaaattaaatccaaacagaagtaataacaattagagcagaaatcaatgaaattgaaaacaagagaaaaatcaaagaaatcaaaaactggttctctgaaaagatcaacaaaatcaataagcctctagtcaggccaactaagaaaaagagacaaaggacaaaataactaatatcagaatgaaaagagtacacatcattacagatctcatgggcattaaaaggataatcaagggatattatgaacaactttatggccacaaatttggtaacctagacgaaatgaatcaatttcttaaaagacacaatctattagaactctaagaagaaacaatcttgattaaaaagcatatattatagaaattaaacatgtaattaataatgttctaaaagagaaggcatcagacccagatggagtctctgatgaattctactaaacatttaaggaagaaaccacaccaattctttacaatctctttcagaagacagaagcaaaggggatgctcctatctcattgtatgaagtcggtcagcattactctaatacccaaaccagacagacattatcagaaaactacagaccaatatttgtcatgaacaaagatgcaaaaattgtaaacaaagtattagcaaactaaaaacaacaaatttctccaccagcacaaagtaggatgtatcccaggtatgcaagactggttcaatattggaaaatcaattaatgcaattcaccgtatcaacagattaaagaaaaaaaaatcacatgaccataccaatagatggagagaaatatatgacaaaatttaacacccactcatgatagaaactagtaaactaggaatagagggaacaccttcaacttgataaagaacgtttacaaaaaacatacagctaacatcatctttaatgatgagaaactagaaactttctcactaagatcaggaacaagacaggaatatccccacctcaccacttcatactggaagtcctagctaatacagtaagacaagaaaaggaaataaagggtatactaactgggaacaacaacaacaaaaatgcctttgtttgtagatgaaatgactgtatgtgtagaacagatacaggaatttgaaaaaaagaaaaacaacaaaaacctcctggaactaataagtgattacagcaaagctgcaggatgcaaggctcatataaaaaagttaatagctttccggtaaaccagcaacaaataagttgaatttgaaattaaaaacacaataccattttacattagtgtgtcccaaaatgaaatacttaagtatagatctaacaatacaaggaaaaattttttagaactctgatgaaagaaatcaaagaactaaataaggaagagctattccatgacccagaagagccaactcaatattgacagaaaaagtcagatggacactactgacttcaagatttactgtaaagctccagttgtcaagatggtgtgatactgacaaaagaactgacaaaacagatcaatgaaatagaatagagagcccagaaatggacccacatagtcaaaggagcaatggcagtatttgacaaagaggcaaaggcaatacaacgaagaaaaaaaaaatagtctttttcaataaacagtggtaataactgaacatccacaagcaaaaaaaaaaaaaaaaaaaagagtctagacacaggtcttacaccctttacaataataaactcaaaaataagccagagaattaaaggtaaaactcaaaactataaaactcctagaggataacataggagaaaatctagatcttgggtttggtgatgactttttagatacggcaacaaaggtaccaaccatgaaaaaaagaactgataagctagacttcatcaaaattgtctacttgtttcttaaaaattgttgtgtcttttgcaaaacacaatgtcaagagtatgaaaagacaagccacagacagggaggaaatacctgcaaaagacacatctgataaagaactattaactaaaatgtgtaaggaagttgggcgtggtggcttacatcacagcactttgggaggccaaggtgggtggatcacctgaggtcaggaggtcgagaatagcctggctaacatagtgaaaacccatctctactaaaaatacaaaaattagccaggtgtggtggtacacgcctataatcccagctatttgggaggctgaggcaggagaatcacttgaacccaggtggcagaggttgcagtgagccgagactgcgccactacactgcagcctgggtgacagagcaagggtccgtctcaatagatagacagacagacagagagacagatatagtgtaaggacctattaaaattccacaagaaaacaaacaacccaattagaaaatgggacagccaccttaacagacacctcaccaaagatacgcagatgtcaattcagcatatgaaaagatgcctcacacatcatacgacgccagagaaacataaatcaaaattataagatacacacctatcagaatggccaaaattcagaacagtgataacaccaaatactggtgaagatgtagagcaacagaaacactcgctcattactggtgaaaaatgtaaaaggatagagtcacattagaagacagtttggacatttcctacaaaactaaacatttttgccataagatccagcaaatgcactccccggtatttacacaaagtcactgaaaacctaagtccatacaaaaacctgcacaccgatatttacagcagttttattcataattagcaaaatgtggaagcaaccacaacaatgtccttcattaggtaaatattcattcacaaactgtgatatgtccagaaaatggaaaaagagaggtactaacaacctatgaagacatggaagaaactttaatccatattagtaagtaaaaatagtcatgatgaaaaggctatatactgcatgattacaagtatataatatgctggaaaaggtaaagctacagacacagtaaaaggattggtgactgccaaggagtgggagggaacgaaagataaacaggcagaacacagaggattttggggcagtgaaaacattctgtatgatactataatggtggatacatgtcattatactttgttcaatgccacagaatgtacagcactaagaacgatccctaatataaactacggactttgggtaattatgatatatcaatataggttcattggaaagacatgtaccactctgatgggagatggaccttgactatgagagaatctatacatgtgtggaaggaggtccagggaaaatctctgtaccttcctctcaattctgtgaacctagaactcctgtaaaaaaaaaaaaaaaaaatttttttttttttaaatagaacacatatgatccagtaatccaacacctgggtatactcccaaatgtgttaaaaacaggttctcaaaaaaatatttgtacacccatgtttatttcaacattacaacattcaaaagtggaagaaacctaaacatccatcaacaaatggttaaagaaaatgtgatatacatatgtaacaaaatgttattcagcctaaaaaaaaaaaaaaaaaaaagaaagaaatcctgtaatatgctacaacacaaatgaaccttgaggacattatgctatgtgaaatagtacagtcaacaaaagacaaatacttaatgattccacttatatgaagtaactaaaatagtcaaattttagaggcaaaaagtagaatggtatttgccaaggaataggaagaagggggaaaagaagagttgttcaatgaatgtagtttctgttttacacgatgaaaaagttctagagatctgctgcacaacagtgtacacacagttaaccacaattgtactatacacttcaaatcattaatatcatccagtttgttgtttttgacaatttttaaaaatctaccccatttttttctttacctcttatataaactgataaaaacctgttttatcctaatcaattatttcatgactactgctccccagagaaaaaatgacatgtgaaatactacgacttatccatctcctgggtctgagcagtacatgtcaggaacaagagggaactgtagctggaagacagtagaggagccgtaggacaagtctcaaagagaaggaagaaaaggcgcaaagaaagaaaacaagtttaagatagtaggaaagcattcaaagactgcaacctgagataaggggttttcactaaaggttttggggtaaaacagtttgagttggcatgcctgtagacatgggaagcagcagtgatgcagaggtgaacattactgtagataaaacagatgggaatttgagttgctagggagtgaggggttcatcagataaataaagatggcagcagatttgggcaagagtgaagaagagtaagttcaggtatcagtcttcaaaaaccgagaagaaactgagagctcactaaaggcagatagaggatgacacaaccagaaggcataagcttcaaaggagcagggatttttatgctgagagagtaacaggaatagttcaaagcagcagtggagaacacgaataacattctgtgtgggagaagaacacgtccagagcttactgtacctataacctagcttctgtaactggaaatgaagaatctgctctagacaggtcatcacttttcactacttattttacttggccttcctaagaaatatagaccttttggaaattattgacttttgggtctaggacactatttcttggtttcctcccttctctctggctgtttttcagagacttcgcttccaaatctagagacatttgtattctccagggatcagctattagatactttctcttttaaatttccctttggacagtttcatcttctttcaaggattgagcaataactaaatgacttccaaatgtctacttcagtataaattctgcttgtcaggctacataaaatgggctcttccaggaattataatgtttaaagaaagagaaagccacgtgatttcagtatgacagagatgactacagaggaatagcaataaaaagagacgcaacttagcagaggtgaatcacaaaagatgactaggagctgatgacactaagggtgggaagaatgtttcagatagaggaaaatgagtaaaagcacagggacatgagaacatggtattataagacaattccaagcacttcaagagcctaaagttcaagaaaagtttcaaaaatatgaaaatggagaggcagggagaagctagatcatggaagacctcactagccatgataagtaattctttttttttagccaaaagaggagtaatctaataaaagctaaagatcttctcctcataaaaacacatgcacacttcaggagtgcacatgcagtcttccggaagattcgtaacccactatattcataaaccattagagaagaactaaaacacaaggagtcactgaagggttttaagcagctaagtggctgataaaatttgcctttccaataactgaaaccaaagtgggcaaaactggaggcaagcaatccagttaggtaatgactactgtaatagtccagacaaagaatgtagtagtagcaagaaaaaaaaagatgaaattgacccaggaagtatttaaaataagtaatttgtaagaggtaaataagctggaaaagctagagataatgggtaaggtttctggtatgggcaacaagatatgctacaagctgagatgttaataaaaacaaaagttcatcagcatgtagtaatttatttatattatgtcactgaatattcaattatgttaagaggcagacagtagttaaaaacaaagaactggtgaatcaaaaagttctgctaatttggggaaatagcatcccttttattttcattaatctcttttggctttgatcctcatttgtagctgacaagaagttctatgtattaaactattctcattaatgtgtccaaaaatctcttgggaataattaagacataaattaattcaaaattcacatgattacaaaaatctctccttagataatctcataatatagccatgttttgctcactctactttgagaagattcagccagaagcagttcatccattcaagtatgttcccttacatttgaaacagaagatacaggtttatatgatgcttcctgtggcagaaaagcagggcagactgtgactcgtgtcactcccacacccgatgcctttcatgggctcctgtgtctgtcagaagaaagcaaagggccttaatacggtcctggctttctacatccaaatgcattttccacacctcccatcagctaactctacattacggcaatacagaacttcttactactcagtggacttgctctgctgtcttctctgattacaggtgttattcttcctgcccagaacacattattcttagttatttccaatcatcctcaaggtttcagcttatatatcacttttaagatgattaggtattcttcctctgtagtctcatagcaaccagtacctattctcactattatatgttgttgtaactgactatcaattaaatgggaggctgaggcatatgacccaataacttatttactgttgtatcctctgaacctagcaaattacagatcctcaatagagatttttcaatttctcttctgatactgtctagataacactgtcaattaaacctaccttcctctaattattcgaccttgaagggaaatacatgtcagaatacctcctggtttcttcagcatatcagaagcatacaaaaggaccttctcaatccagagaccaagaatatgatatcagaacctatagaaaaggattctgaaaatacgagaaccacttatttgattgaagagatttacttcggaaaatatttcaagaagttacttgtcccaaaattctcatagatgtgtaagtacaccgaagttagaagtcatataggcaataaaagcatccaagctctatttccatcatctactctgattaaaaggctcaactctcctatcaaatttgagataatcatgtggattatgcagcacagtgacttgctacatgttcaatgctcaaaaagatgataggtgttattagccacatcctacgggctgcgtacatacttattagtttatatatatacataaactgatcctaaaaaattcttcctacatttctgcaagagaattaaaaaggcagaaacaaacattttgcataaatttactagcttcattctttcatgtaggaaatagttactgactaccttctgtatgccaggcactgtcattaggcttccattctagtggtgaagcaaaacaacaaagaaatcaatatgcaagacgtcaaatgacattaaatcccacgaagaaaaatgcagcaaggtaaggggaatgcagaagattgaacctgatcattctttgatgcagctggtcaggaaaagcatcatttgagcagagagctctttctgaatcaagtgagcaaggaagccacatggattatcacagagaacggtcgcagggtcactgacaatagttatgagacttaagatgacaaggatacagtcactgtagacagagataagcaagtaaggtagagagatcacagaagtgaaaggaagccagttcatacagggccatgtaaatctccagatttcacttttaagatgggaagcctctgaaaagttctgagcataataaataacacggtttaactcagattttaaaaatatcattctggctgctactagagaatacactgtaaagtgtaagactcctgggaaacaatttctttcttttgccaaaatatgatgcctttaaacagggtaaacagaagtataatggttaaaaaaaaacatgaggcatgggtattttgaaggtgtagccaacaagatttaccaataatttgagtatgtgacatagagaaattaaaagatgcttccaaggcttttggttgcacaggagggaaaaaaagttgttactaactgagacggcaaaagatgatgagagacgtaggtttgggaggatgaaaatcaggagctccacttaggacatgttaagtttgagaatgagacttaactgttggataaatgagtctacagttcagagggcaagagttggtgatggaaataggagagttgtcaaagcgtagattaaaagctctaacctagagagaaagaataaaaacgtccccaggactgggtcctggggcatttctgacatttacagtaaactgaacatttattaaaactaacttgctttactgaaccataaatcacttgctgtatttacccctgctccatttatagttatacacctgaaaacatagccttagtgttagaggtaaagagtaaataccaaacataaaaaatccaatctggtagggtgcggtggctcacgcctgtaatcccagcgctctggaaggccgaggcaggcagatcacgaggtcaggagtttgagaccagcctggccaatacgggcaaactccaaaaaaaaaaatctgaagttactgagaaactgatatgaaatcattaagaaaattaaggggtctaaattaatacatacaacaaagagatcccacaacatggtttttataaatttaaacaaaatccatggccaggcacggtggctcacgtctgtaatcccagcactttgtgaggccaaggcaggaggattactttggggccaagacttcaagaccagcctgggcaacatagtgagaccctgtctctacagaaaaaaaaaaaaaaaaattaatgttttagcctggcatggtggcatgtgcctgtagtcccagctactcaggaggctgaggcacgaggatcacttgagcccaggaattcaaagttgtagtgagctctgatcacaccactgcactccagctctgtcacttatgacaaagcaagacactgtctcaaacaacaagcaaacaaaacaaaaaactaaagtaaatccaggtaaaataaacatacaaataaatgaaaaggtctgggttattgcattagttctgtttgtaggcttaactacaaaatggtgtccagttgttaaaaatgtttgcttaggagtattgattttttttattatgctcttctacattctaggaaattggcaacattaagaattcctaaaaacaaacaggagtgttaagtgtataaaaattattatttaagatgcattcaaggcattccttagttaaattaaaatatcaaatgcatgtcaaattacacacaaaaaaatcatgcttcaacaaaagtgggatgttgccattaatggacagttagttctcaggtaaaaccaagaatccttcattacctattctgtaaattaggacaaatactattaaggtattaggttggtacaaaagtaattgaacaaacccagacctactcacctcactgaaagtgctgcctggctatagtctctagatacaggaatgtgagaaatggtagcagccttgaaggtttagagctgtattctcataccaattatggctagaaacttaaacagctctactgagacattatgggaggtctaatttcctgttactctactttaacacagccaagtaaaacagtaagaaagcttgcttaatttgacaaggactgaatgccagagtgtcacctggaaacttgtgacaaataatcatgcctcacacattcatccttggtttttactaccaaatgcaagcttcatctatcctcttccattctaaacttgactcatcctcctaacctcttccagaaagatctctagaaacccagagtctttctgaagacccacaggctgtcccctatcttcaactactttacataatggcccctcaacttcttagctttcacgaaagcctggctcttccctgaaggcacggcctatcatgcaacccttttatgtgactcctaaaacccaagtccaccattattcttctaatactctgtattaaaaataaacaacaaaattccctgtattaaaagcaaacaacaacaaaaaacttgtaatttgaaactcacgtcatttaactgaatgccttctctttctctctgttctggtcaactcaacccacatatttaagcctccactttgcccccagttacatcatcagcaaagtgacttcaatgtccctgtacatggttctatcccaatactctaggcccccaaaatatctgcctttctaaatttgagatatcttcacctcctcatttcagcaaatcactcccttgtctttgttagacatattaaaacctctgataatgatcatctcagctatctttataacagtttcactcatactcatatctcctttcacctatcaagacaccaggtttggtgacaaataaaaatgatacatatttgggaggctgaggcaggagaatcatttgaacccaggaggcagagaatgcagtgagccaagatcatgcatgctactacactccagcctgggcgacaaagcaagactccatctcaaaaaaaaaaaaaaaaaaaaaaagatacgtacttattgtatacacatgatattccaaaatatgtatacattgtggaatggctagatcaagctaattaatacatgcaatacctcacatacttacattttacggtagaacatttaaaatttactcttagtgatttccaagaatacactgttactaactagtttccatgttgtacaacagataccttgaacaaattcctcttaattgaccaacatctctgcaacccagtccatccacccccagcccctggtaaccaccattttacatctctgagttaagattccacatttaagagagatgtagtatttgcctgcctttgtgtggctggcttactttacacaatgccctccaggttcatccctgctgtcacagatgacagcatttcctccttttgatggctgaagtgtattccactgtgtatctataccacattttctttatccatgaacgcgtaggctgatgctgtatcatgggtattgcaaacaacactgaaaggaacacgggagtacagatctcttcagcacactgatttcattctttgatacatatatatatccaagtgtgactgctgaatcatatggtagttctattttttaatttctaagcaaacttcatgctactttccataaatgctgtactaatttacattcctaccatgtgcaagatatctccaaatcctcatcatacttttaacagccattctaatggccatttgaatgtcttattttgagaaatgtctattcaagtcctttgtccatttcttaactgaggtgcttactattgagatttctgagttccctatatattttgcatattaatcccttaacagatatatggtttgcagatactatcttccattctatgagttgttttttcattccgtagattttttctttttgccatgcagaagctttttagtttgatgtgatctcattcatcttttatttttgttgcctgtgctttggggtcatatccaaaaaaatcactgtccacaccaatgtcatgtacatttctcctatattctggtagttctacagtaacagctcttacttttaagaccttaatccattttaacttgaatttggtatatgatgtgacatacaggtctgatttcattctcctgcatgtagatattccgttttcccaacatcacctattgaacagacttccctttccctgctgtgttctttgcaccttgtccaaaatcaactgacagtacgcgaatttatttctgtgctctccattctgttctatgggtcgatgtgtctgtttgtttcttttgttttgtttttaaaagacagggtcttactctgtcatccaggctgcagcgcagtgatgcaatcacagttcactgtaaccttgagctcctgagctcaagcaatcctcctccttcagcctctcaggtagctaggattacagatacacagcaccatgcctggcttaaaaaaaattttttttttgtagagacatggtctcactatgttgcccaggctgctctcaaactcctggtttcaagtaatccttctgccttagcctccccgagtgctgggatacatgtgtgagcaactgtgcccagcctgcgtgtctacttctatgtgactaccatgctgttgtaattactgtagctttgtactatattttgaaatcagatagtgtgaggtctccagctttgttctttttactcatgatagctttggctatttaggatcttacgtggttccatataaattttggcactgttttctagttctgtgaaatttaacattggaattttgataaggattgcattaaaactgtagattgctttggataatagaaacattttacaatattaattcttccaatccataaacacaagataactttgtttatttgtatcttcttctatttctttaatcaatgctacatagttttcaactatttggttaaagttatttctaagtacaattatccctcggtatctgcaggatactggttccaggatctcccatagataccaaaatccatggatgctcaagtccattatataaaatggtataccatttgcatacaacctatacacatcctcttgtatgctttaaatcattactcagtacctaatacaacataaatgctacgtaaatagttgctatactgtagttttcttattgtataagaaaacagtattttttattgttgtattttttttctcaaacattttcatccaaatgtggattcaatttgcaaatgcagaaccaccgatactgggtgttttgtttttggtacctatcataaatggaattgtcttcttgatttctcttttggataatttgtgattaatgtacagcaattctactgatttttgtaacttgattttgtatctcacaactttactgaatttgtttatcagttctgacagttctctggtggagtctttagggttttctatatacaagatcatgtcatcttcaaacaggtgcaacaacatcttcctttcctactgggatgccttttctttctcttgccgaactgctctcacaaggacttccagtactgtgttgaacagaaatggcaagagtgggcattctcgttttcttcccaatctcaaaagaaaagctttcaacttttcaacattcagtataatgctagcagtggatttgtcaatatggcctctattttatagaggtatattccttctatatttaatttgtgagagtttttagcacaagagaaagctgaattctgtcaaatgctttttctcaattatctcaattatctattgagatgatcatatggttttggcctttgttctcctaatgtggtgtatcacatccttgtacccttgcggtaaatcccatgtgatcacagtaaatcatccttttaatacactgttgaatttagttattattttcttcagaatttctgcatctaaattaagaatacaggtctgtaattttcttatcctggagagttgtttggctttggtatccaggtaatgttcatctcccaaaatgagtttgaaagtattcccccttcttaaatttctcataaaattttgagaacaatttgtactagttcttctttaaatgtctgctagaattcagcagtaaagtcaccaagtcttgggcttcctttggtgggaagtttatacaggaaggattatataggaaggattataactgatacaatccttgtcactgttcaaatttttaatttcatgattaagcctgggcaagttgcatgtgtctaggaaattatccgtttcttctatggtaatcagtttgttggcatataattgtcccgtctcttatgatccttttatttcttgtacttctctggtatcagctgcaatgggtcctctttcatttctgatttaacttgagtcatctctttttttcttagtctagctaaagacttgttgcttttatcatcaaaaaacataactcttaatttttttgatcgagttacctttttccttagtctagccaaataacctgtcttttaagttcagattcttttgtctgtttgctcaattctgcttttaatgctcttttgcatttttcattcaatttattgcattttcagcttcagaatttgttttttacaaaataatttcaatcttgaaatttctcattttgattgttttcctgattttgtttaattgtttatctgcattttcttgaaattcattgatcttccttaaacaactaccttgaattctttgtcaggcagttcatatatctccatttatttacgggtggttcaggcgccttattgtgttcctttgactggtgtcacatttccctgactgttcttgatccttatagtcatgtgttggcacctgcacatttgaagaagctgagacttgttccagtctttgcagagtgacgttatcggggaaagtccttcaccagtcggcctgtccagagatcatgcagcctgagtccacaggggctggcctggcatcctggtctactagagtgagcctgaaccttgggtctgcaaggaccagtgtgaaggctgggtaggtgggtgttggcctagaatttggatcacaaggggctggccaagtactgggtctgaacccttgttctgcagggatgtgaggccacaggggccgatctagagggcagggctacagtgaccagcctagcactagacaggcttggagtctagggctatgggatccagcgtggtgccggggtgggcctgtaggcttggtttgtgggtattggcctgaagtctgggaccatgggggcccgcctagcactgagttttactagggcaagctcaacgttagggtctaagtctggtgtacacttcccctccttcaggtcgacagtatctctctccatgatgggctgtcagggattgagggaggtgtgatgcaagtaatgtaaaactgtccttcttacccttttcaatgtatcttttcttatttgtgtggcacattcaggtaatctctcatctgatttcttagctcttatatttttgtgtgtggatagttgttcaaattgatggttccacaatgagatgagtgctgcaaaatgccagtctgccatcttgctgttatcgagacctcaggcttttcttaaaacaactcaacactttggtcgtgcatcccaacctttccaatcatggccatcatcaacagcatatgaattcaaatactccaatgttaacatcttatgcacatgccactagtgattctgtttcatcagctctgctaatatccaaccctaaaataccatgcataatcttctggctattggagaaaagtcttgaaatttcaagtgtgataaggtctttaatcttaactagccactcagtggaatgagattctcctaatctgatatggtttctggtttcaggtagccagccaagattctcaataacttttgatcaacttcttcacccattcccctcagtagcttcctaagttttcagtcttctcaaaacttctaaacaaaccctttattccacaaaatattattaaaaaatatttcataaagtttcgtggtcactaacctacagtaagatactaccttacacccactagaatgactactattaaagtacacacacacacacacaaatatgtgatgggaaggatgtcgagaaactggaccccttgtacactagtggtagaaatgcaaagctacaattgctctggaaaagagtatggcagtttcttaaaattttaaaaataaaattaccatatgatccaacaattccacttctgggtatgtatgcaaaacaattcaaagcagggtctcaaaaagatatttgtacactcctgttcatagcaacattatctgtaatagctaaaacatggaagaaacctgagtgctcatcagcaggtaaacggataagcaaaatgtgatatatacatacaataaaacattattcagcctgaaaaaggaagcaaattttgaaacacgctaaacatagatgaaacgtaaggacactgcgaagtaaaataagtcaatcataaaagggcaaaaactgtatgatttgcacaaaaactgtatgatggtacttagagcagtcaaaattagacacaaagtagaataatggttgtcagaggctgtgaagataaggaaatgaggaattattgtttaaagggtacagagtttcagttctgcaaaatagagagttctgacggtgactgtgcaacaatattaatatacttaataccactgagccaaatacttaaaaatggtgaaatggaaaattttacattatgtgtattttacaacaattttttaaaacttaaatgacaagtcacatggctgagtcacataaatttgagaaatacattttatagtcatttcttgcatattcacaacatacaccagcatttaaatagggttacaatattttcagtaagaatatcttgatttttccaacctcacccacaattacaattaatatcacacatccaccttaacttccttcttctaatttcattagatgggcatctttcctcttattcaaggtcaatcactatatctgcatttttctttcttttatattacctgtatgagagatacacctgtacttttcattccaatccttactaccttgaaaaactttgctttgataattactacctctattatctgaaacatctttagtctttacaataaattcactagtcttacttacttcatgttctaaatattttttaaatccagaaaaatttatcttgaattcctattataccactgtcattgttaaggttctcactgactgaactaccttaccaccacacgtttctcttcaatcctttctctgctgcaaggttattaaaaatacacgtttgacaaacttactactatctacctactgagcaatttctttgctgactcccaaatacctttctatcacatcttatcttcttcattttcctacctctcagctagcttatgatctacaagtcctcaactgcctattgcccctactgcctatgctgcttctgaactttggctcatacttctgcctagaataagctggtcatgcctctacctgcctgattcccagtcacatttcaagactgaactaagcatttcctggccactcttacttccctgccatctatactggattcctactgcaagcctgggtactcactccagtactcctttacgttactattgtattctggataccattccacctcaacgactgaaattatttgcttctgcatctttcactctgagtataatataaatttctgtagggtgaaaactaattattgtgcatctctgtatctataacgtagtactgatgccttaaacatggtagccgttgagattgttaaacttaactctttcctcaattcccctatttccttacaactgctaccagggaagcaaaaagactaagaattcaggcgtgtgcaattatctatctagtagtagaaatccagtaaactgttaccaaggtttagagttatctggtaggaagaaaagtaggtatgttcctatgtcccaatttactgctaaaggattcctttagtttaaccagaaattatttccaaataatgtgacataatttaaagcagtctagggcaactcaaaataagatatcacagtctcaaccaagttacacttacattcggctagcttcaatgtcgtcagactgaggttctcctgatctgtaaaatgcaattgagaaacagttagcaaaatattccatactccaaaaaaaggtagacatattacttaggaagacaaatttgtaaacaagatttcagcactaaataaaacagttttaaaaatacagacgtaaacatgaaagaaagtggtcagatcaagtggccatacaacacatttattttaatggttggactatcaaaaaactcaatgcatgttttttaaaggaaactgtaaacgctatacatagataccaacagacaagccattataagccataattattcacaaagtcaaatacatgtaataaaacacacaactataaaacttcctatagccaagtattggttatccacattaacaaaggtactcactggtattcacttgcagtattaacctttagattagtgggtcagtaaactactccctaggcagaccgactaaagcctaggccagccatgtagttttgtaaacgaagttttattggcatgcagccatactcattcatttaggtatcatctatggctgctttcacgctaaaaggacagagctgagaactcgtggcagaaaccacatggcccacaaaacctaaaatatttattttctggcccttaagaacaaatgtgccaaccgctaccgctactctagacaatgcaaactaaaatccagtaccctggtaagtttaaagacacttaaattagatacaacatccaaatgatgattatcttggttcaaaaatgaaattgtttccctaaaaatacacttactgtatgtattacctgtcaaaagtgtattacctgaggtaaagttttgcactggatagctgtgaattaacttccgttttaaatagttgccagttactttgttatttctaaatataccactgctctcttatgtagaaatatttaaaattctaagtcactaaaaagcctttcattttcatttcacgagacatgaatcagtatttccctatctctaccatgtcgttaaaaataagttcctgttaccctattcacttttataaacagcatcagcaacaatgaatgatgtaaggcgagtcaatataatacggatttctaacacttagaaattcccaaactagataaaatatgttttttgaggtcaaaagctaaattttctaattggcattacaaagtcctgatttgtgaacttctcactgactttaggcttccaactttaagcaactctaacaagaatcaaaatcagagtctcacacacacactctctctctctctctcacacacacacacacacctgtttgataaatgtcttagcttaaaaacaaaaaaacaaaaaaaaacttcacttctttatcagactctcaaaattaccctcactgcaattcattcagattccaaggacaagaatggaaaagaaaaaaaaaaagactccagcagctcaaatatttattttagatcttctttgcaatgtatttaaattttcaattttgcacaaaattacgtaagaactaaaaactggggcatgctggaggtggcagtgacttggcagtgacacaaatgcaaaaatttcactccaccctctcccccagggagcaagcaaaccacctatgtgacacacctggtctccaccagcctgtgggtaagtaccccaagattgcttccaaacttgtatctcccagacagaagagctaaaaattgatgataaccccatgtaccagctgactcatttttgaaagtgcgaccctccagcatcagatgtcatactgtaaggaggcagagctggcttgcaaaacaaaaaataaacctgctggcactgagggaagagaggcagattagaagctttcaaacacgtaggcagcaaaactttcaaaattaacagggaaagagaagagaggggaaaaaatgaggacatgatgataggaaaataaaaatattactgcaaaaaggtaagacacaagaaggaaaacaaatctaagtcttagaagtacaatatgtaactgttacaaagttttgagatcctgcaatgggatagaatttaaatacattatcaaatgataactatatctgtcttcccaatttctgtttcctaagcaagagaatatgtgaactttggcatcaaaatgtcaccaaactgtaacatattaattactactttttacatatattaaagtaggctattaaaaaccactgataagacaaactaagtaaaccaattcagtatagaagaaggacaaggactgaaagattattaccttaaaataaatctgtcctggatctattaaacatagcaaagttgttctattcaaattgcaaattgttttttaatcaagagaaaaatgaatatatacagaactagcagacatttttcttgcagtgaatattaataatttatgtctgaataaatttctactcatcctaataacagtatatttctagaatagtctaaataagttaccaaaaaaatcccaagtttagaattcaaactctcaaaactatgaaatacgccaggtgtggtggttcatgtctgtaatctcagcactttgggaggtcaaggcataaggatcacttgagctcaggagttcaagattagcctgggcaacatgatgaaacctcgtctcttagccgggtgtggtggtgggcgcctttagtcccagctacttggaaggctgaggtgggagggtcacttgagcccaggaggtcaaagctgcagtgagctgtgatcgtgccactgcactccagcatgggcaacggagtgagaccttgtcttggaaacaaacaaacataaactatgaaatatataccacctagtaatagttcccaagcttgactgtggctcctaaagagtttacttattcttttactgccaagttgctggaaataagaatcctgtatgtgcttgtaaatgcagaacatataatctaattcaaaacatataaccaaagggaaatttttgtattaaactattgacttaggttatcctaaagtgtgtcagaataacaagtcagaaaagaaattttaaaactgaaacaataaccaagtaacattagataataaaaagtaaatcttagaagagtctcaattttaggtcttgatttgaatcgcagaaaatatgatcacaaaacgcccactaatctgaatactgcagcatgagctagcaaattcaaatggtggctcacttccaataacactggtgcagcttctccatcctgcaagccactccttttacctccactgtaactctctaggagagaaaagtatactagttttattaatgtcataaaaacttctagagaaatgtttagttaaaacgttcaccacataaaaggcatactttaaaatacatattaagaaatttttcatgttttctataaggtttatagtaaaatgtttaaaactttgaaggtttttgagaaatactttcctgttcatacagacaggtctttgatagtggctactgatatttttaatagaaaaaagacactaaaatattttaaggagattaaatgaagcaggtcaactctcaggcccactattcttagcaatattcctgccaactatacattgtcttcatttctacagtatgtatttcactttacaatgacagccttttaaaggctgtaaaataattcaaaattaccttttacaagctgtggccattcggtgacatcagggtgatcacagctttgagtcactgattaaaaacaggttgtcacaccagtctagttgctaccttgatctgagcgtaggcttaataactctaataaattaaacaaacctttggttagaacactttaatatataaacccaattcattgttcaaaaaataattttcaaagcttcaaattaggtgtcaatgtaaaattcatcagaagagtaattattatagaaaagtttttaaggactattttccagcattttgtttttcttaaatgatctcttcatttgagaaaatgtaataattccttgtacttttatgtaattttacactttatgaagcattttggtcaataataccttgagtcttgtaacttttgctttacctgatcgagacagataatatagtaagaattttttaaaacaaacaaaaaaaaattaagcagcctccgagtgattaactgacttgcccaagattttggaactagtgttgaaggaatgattaaaacccagatatactgacttcctatcaagggatggattttttcgtttgtttgttttggcttagttttgctatactgggtttcaagatttaagtatacgtaatgagtaaagattcacaacatagattgagatctttcaaatatggcaagtttaagtggggactaatttactcaaaagattcttaagctgatagagaaatcagtcaccaagtagtcaaatgcttaatggaatagttatatatatacacataaacacacacacacataaacacaaagtctagtcctactaactctatatttacgtagagtcatttaacatcagtcaaaaccccttcagtactgcatgaaaatatgttctactctttcttggccataaacctactaagatttaatttcatgaaaaagtatggcaaaagatgaaagcatatcctcctccctcaaccaagtatctttttaaccccttacatggccttagctgaacttttctgattgtcacagttcaaatttagcaggcctctttactcacactgtagttctggcaaagataccacacatctgaaatattccagtatcaaatgatcattttgtacaactagttctttcccctcacgattcccctatccaggccaaatctgaggtgtcaactacagaaaggtgaggaaattaggaggaagaaacatttcgtagttaacatcctcaaagcaacaacagtcaagcgcagaaggtggttaccagtgtggattcagaacccaacataaaacagcaaggtatctgcaaataccaagggttaaataaaacatgaatgtctgagcccatacctatgcagttatgaatgcagggcttcaaaatccagattaggtgaggactggcctgaatatacaaaaataattgtaggggattccaataaatggaatttacagtatctgtaagaaataacacaatctcccagatattcctatcctaagcatacatttcctaataagaacctagacattgctgaggtcatatgggaaacaccaccttccctaaaataaacaatgtggtcatgatacagctttcccttgtgttctcaagaggctaatggtatgtggaattagaagattcaaacaagtctaactttctatcttgtaaacacaaaaataataaagttaaaataccttttaattgactaattgatctcaatgtaatgaaaagagctatatgtattttgaaaactactgagtcaagtcctctcttccagtcccctcttttatgagataccgtgctcaaaaggctccaaggccaggctggatttacgtctgtttggtcactcactagctgagaaatcttgggcaagttacttaatctctccgagtctcagtttccttagacgtagaattagggtaatagtacctattccagagagctgtcatggatgcacaagctaacacctaaatatctcagaacagtgcctgacatataatgtgctcacaaatggtcgggtatggtggctaacacctgtaatcccagcactttgggaggccgaggcgggtgaatcacttgaggccaggagttcgagaccagcctggccaacacggtgaaaccccattcctattaaaaatacaaaaattagtcaggtgtggtggcacgcacctgtaatcccaactacccggcaggccgaggcatgagaatcacttgagcccgggagatggaggttgtagtgagccgagaaggtgccactgcactccagcctgggcaacagagcaagactctgtctcaaaaacaacagcagcagcaacaacaacaacaaacggacaagctattaatactcatagcctaaaatccaaacctgccctctcaatctttttatgcgtattattttaccttcatagcaattgtaaatgttttcagcaccctacctgggtccctcatacagtcttggaagtgtagttagtgagcacctgacacaatgctttaaaaatggcaggggcccaaatttgctgaacatatctgtcattattatgacattaagatacacatgcaatacgaattccaaaaaataaaacaaaaacataccatatttcgccaaacttctgaggagctggtgaattctaaaatcaggctcttacagatttttaacctaaaatataaaacacctcactcaattctttttatataaacaactggataaactttcaaaaaaaaaaaaaagaggtactaaatttcatcatgaaagcaaatttattttctataataattatgaacatccaaaaacgtatcaagaaacaaattactctatagaggctgccaggatgaggaaagcataggtaggcagccctgtggcctgagtgctttcagcaggcaaagccgtatttcccatattcattcacaaagcttactgccttctatttctttactctatcctccctccaaaagggctaaatacataggaaaactatttgactatatccccctaatcccttcaaatacctatagcaattttgtttttaattctatatgctaagcatcggctatgttaggtacaaatctgggcatctacctaccactttccagagtagcagccttgggtcgaccctctgacccttgagtctccaatgtcaggttatagtagtagagaagatgcattaaaaaagcatagtataatgcctacctggcacaaaacaggacttcaatatactacgataattacaatttattaaatcaaccacttaatatatatcaaaacttaactcttaaaaaaaaaaaaaaaaaaaaaatcctgacgcttacagcaagcccctaaagtatcgctgtaaattcttaacttgtttgtatacaatcagaacgttcctcaatggaacagaaataaagtcctttaatgtactgcattacatataaagaaaccaaatctcaaagattaagaaacctatccagtgtcctagaggttgattgcagaaaatgaatacactgcatatcaacattttgaaataaaattaaccaacttttaaggttttagagactgagtttcaaacttcagcctataacaaaattacctggggaaatctaaaaatgcaactactcgggctctacccgcaaagattctcattcaatgcatgaagtaggggttcatgaattatttttttttatttttttcagacccatccaagaacacagaaatgaatttgcattttaacatatacttcacatgacacacagatctcatttgaagaagccctcccttccaaattacgagttaggaacacataatcatagaggaaatacaccaaatctataaaaatacagaataacaaaaactgtaagcattacaaatattaggcacactcacttgccaatttaaccataagaatcctaataccagacatagttctcttactttatctcttcaacagagggctcagtctaataattttataaataagtatagtctaataagacatacctatgttgatctacatctgtctccctaaaattttcattttattcatttctatttctccttcacctccttctaaagctgtttcaaaacttaatttcacaaactgtttttttttctatcactttttatcataacatccaacacttctgttctcctttgcaccatgtttatggtgtcttatatttatggataatgctacttattaaaactgtctacgtttcatccgtttacacatttcacaactaaaggactactccaacaattttcctaagtcttcctgctttaggctctcctcatttcagtccattctgcagttaagacttaaaaagttttaaatactgctttcaaataatacttgcaacataattccctcaactccattagctcctcagagtaccatttctttatcctctttcctttcactgccaaaaagacgtgaaaaccactagctcagctgctgttttcctacctactgaaatttttcttacaaaagtttccatcatttctgtatattctcccagtgctttggccccttaattctacttaatttttgtagcttttaagactgctaatgactcctcatctcctctggcttccctcatgtaggatccactcatttccttccatccctctaaaggcaacaaggtcgtctgctagttcatcttcctacctctcatacatggcctctctccaagtttcggtcaatagccatttttcttaacctaaaccaattttctgcgcaatgtcatccattcccatagcacctctatgcttacgaacccctaactctgtatctttaagcccttatctctggcatggtatgcctgtaactacatattaccaacggtacacatccatatggatgtctaattagcatctacattcaacgtatctaaaatcaaactcaaattattttcccaaagaactcactctgcctaatctcactgtcctagttatgaattgaaaaatttggccgggcgcggtggctcacgcctgtaatcccagcactttgggaggccgaggcgggcggatcacaaggtcaggagatcgagaccacggtgaaaccccgtctctactaaaaatacaaaaaattagccgggcgcggttgtgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaagaaaaatttggtgccattcattactttctccccctcatttttatttgccctgaccactgtgtaggttgatactcattcagccttcaaattcttcataatcattaattcgaaaattgtctactagattttgagtgcctactaggtggatgaagatgcagtggtagaaaaatgagacataatttcttgtcctcatgtggtgaaggaaatgggcacaaataaaaaccacaatgaattatgtaattgcaatgcacagttaagggttgtgatggagaaatacaaggggtaagttgtgtattataataaaaagtccttagtctgaagaaaaggaaaaccattctttatgagggacaagcaacatttataagacacactaagaaaaatcctgtgaggtaatgatggtagcactatcagtccagctgctcaaattggaagattctcagtcatattctaaagagtctctctctttcccagtatatccaattgtttaccaattactactaattcacccttagaaattcccctacatttctacattcccacactattccccggtcttttttgatggcttttagttgcttccagaataaagccaaagctcccaatcatgtcagatgagactctacacaatttggtcaaaacctgccagtgcagcctcttcttccagactagaccagacttcaagagaatatgtgtatcatttgcttttatacttccagtgcttgtaaatgttcatagaataagcatcttacaaaagacaaattttttctctttggggacttgttttcagtcctttaaatgcaatgcaggttaagatttaaactctaatttgtctaattctaaagaccacgttcatcattcccttgtacctgccttctaatttatactcaaaccctatacatttccttaaaaatatatcttactccttttttccccaaacttaccaatactgtcctactggtttcccttttgcctttatcctcaattttcccactagcattatcttcctaaaaactcaaagttatacatatcgttctatattcaaaagctttaacactttctcatgccaaccgaataaatttctaactccttcacattttatatgaggcccctgcctgaccccagccatcccagcactactgcccactacatgacatcatcaccaggtaccagatctagccccatcatttgaccactggctataatacactggatatctgtgtttctgacttcaatgtgttcgcttctgaggagacttcactcagaaatggttctctatccattactaacctctatcccccacccacctatcatgccatgttaaaaactgccctcattctaaacactgtatctcacagggttgtctaaactcttatacataatcaccgtctccttcatgtcttattatacattcttaataccataaaataattaatgtctccttatatttattatgttataccttacattacagctatctgtatacatttgtcagtgcctctagttgtaagctgattgatgtagggatcatctcttccatattttaattttcataataatggtgactatgttttcttgacaccatacctcccctctacaaggaaaaaaaaaaaaaaaggaatcaggacccatggcctttgagctagttccaaacgtgactcatagatgaacaaaggtatcatttcttcccaaagcaacacaaatataagtaaatgccaatttaagaaacattttatttcaaggactaaatatgtaagaataaccaaaacaactgtttctaataatgtccctttctctaccagacattaaaacatattaacttaaatggtataattaaaattagcacaacaccttcaaaaatggagtatacactaaatatatgcataccccctgacttaaaaatttccctcttaagtatacatcaaaaaaattaagtacacatattcacgagaagacaatcactgaaatgtttagagcagcagcaagattcttaacaattccaaaccaaaaatgattaaatgtccatcaacagcagattaaactgtggcatattcttaaaatggaatactatacagcgactatcataaacaattactacaaccaacagtgtggataaatctcacaaacacattaaaagcaatcagacacaagtaagtgtgcttgattctagttaaaggacgaaaacaggcaaatctaatctatgctatgagaagtcaggacagcggttacacatggaagaaaacggagggtaacagagcacaagcgagcacacaggagcgagcacacaggagcgagcacacaggagctgccgatgttgcttcttgatctgaacgctagctaaatacgtgtgctcagtgtgcgaaagtgcagcaagctatacatttggaagtgcactcttctgtatatttaaaagatttttaaaaaaaatctgatatggtattagcattagacaaagaggtaaacacaacagaaagctaatttcagagaaagatccaaaagtatctgacagttgctccttctcaaacaagaattttcagaccttggataacaggcagcacaggactgtaatacatgaaaggacaaaaacaaaggaggtgagccatccactgcttggatgcctgcctggaggtaatttccaacctgcagtcaatggaggggaacccaacgagaagacagcagtttcagtgaggtcagaatcaagagatcagagctgaggaagccgaagtgggtaaaatgtatgacaagtgccagacaagaggggtgcttgtctgagaaggcagagaaatggcttcagaaatctgtcatgtgagagtctactgctgagtactaactgtacacgattaaggtaagtggaagctagggaaagaggggcagtgagctgaaatattcccagtgcttataaaggaccgggagactcctaaaattccctctaacctgagcgaagagaacacggtgacactgggagccttctctagacaaactccaatgtagccctgaaggaataaaactgaccagcaagttatttagctggctacaaaacaaaacactctaaaagaaaacaaaatctagtcacccaacaacaaaatattacaatgtccagcatccaatcttataaaatcattaaatatgtaaaaataaaaataaaaataaactaggaaaatacaacccataatcaagagaaaaaaccaacaaattcagagtgaaaaaaatcatgaaatcaataggtaacctgattttcagttattacaaatatgctcaagatttcaaaaaaatacatgaagatgaaaatgaatcaaaatggaatttcttgaaatataaagcaaaatatctgaaattatttaacaaggcaggagaaaaaacagcaaaatagaagacaaagcaaactgaagcacaggcaaataaaaaaactgaaaaataatgaatatgacgttaatgacctgtggataataccaaacagtctaacacatgtgtaagtggagtcccagaaaacgaggaaatgatgaaagaggagaggtggtaaaaaatacatatatatatatatatatatatatatatatatatatagaagaaacaatggcaacaatcttccaaatttaaggaaaaccataaatatacagatttaaaaaaaacacaactcttagcatggtcatcatcagaaacaaaaagggacaagaaaaaatcttaagagcagccagggaaagaagacttagtatcaggaagaaaagataattagcattatgcatcacttaacagcacggatacattctgagaaatgtatcattaggtggcatcattaggtgattctgtcattgtgcaaacatcacagaatgtacttacacaaatctcgattagatggtatagcttactacagaactaggatatatggtatagcctgggtgctcctaggttataaacctgtacagcatgttactgtactgatactgtaagcaactataacacagtgtaagtatgtatctaaacctagaaaaggtacagtgaaaatatggtggtataatcttaaatgactattgtcaactatgatctcttgttgactgaaatgtcattatgtggcacatgactgtataatcagacttctcatcaaaaacaaacgctgaaagaaaaacacatcaactatttaaccaagagaaaagaaacatatatgtccacacagagactgttttcacacaaatgttcattgtacctttatttataatagctaggaactgaaaacagcccaggtgtcccttaatagatgaagtcacaaaccactgaaacattcaacagtatggatgaatctcaaaaacattatgctgagcaaaaagaaactttttacaacacataagtattgtatgactctgcttacataaagttctaagcaagttaaactaagatgaaacaatctgaacaatgttaggttctacgggtggtgtggggggaaggaataactggaaagaggtgcaggttctgtaccctgatagaactttctggcaaaggtgtatgcatttgtcacagctcatgaaatggtgtatgtggtcaactgtattttccaaagatggtcacaacagaagccattctacatgctcttaacaatgtaacactgttatcttttcatcaggtggtggagtctatggcccttctctttgaatctgagcgaaattagtgactctttcaatccaaagactacagtcgtacctcaactatctacagaggactggttccaggactcccatggatcccaaaatccaagaatgcttcgaatcccttatataaaatggcatagtatttgcatatgacctacatgcatcttcaaatatgttaaaccatctctagattacttataataccaaatacaatgtaaatgccatgtaaacagttgttacaatgtattgccaaagacaagctctccttgccaatccctgaccaaatgagagattcatgagcaaaataaatagttgctgatatgtaaggcactaagtttggggcaatgtattacacagcaataaataactggaacagcatagtaaattgtagttaaaaacactaaactactaagttttagttaatatacatgctgaagttaagggtgtggtatactaacatctgcaacttactttgaaaagcataaaaaaagacagttgaagacaggatggatagatggacaacatagaagacaaaaacaaatataacaaaatgttagttgtgaaattatattctacaattattttaaagtctctgtggcttgaaaaattgtacaataaaatgttgaagagtgaaataaagacatttccatacaaataaaagctgaaagattttgtagccagtagacctacactttagaaatgtttaagaaattttttcaagtagaaggaaaataacaccaagaaacttggatctacaaaaagaaatctccacaaaggaaaagaaataaaaatggtaaataagagggtaaatagaaaggaatgttattcttagtttttaaggttctttgtaagacaactggcttttgaaagaaatagtttcaaatgctactgtggaatctataacacatatagaagtaaaatgttaagctcacaataccaaaacgaatgagggagagtaaatggatgtatactattctaaagttcttacattatacattaagaggaataatatttctgaaggcagactgcggtaagttaaaggtgcatattgttaatcctagaagtgtcactgggggaaaaaacagagggacaagctaataatggagacaaaacaaaattccaaaaatgctccattaaacgaaaagaaggcagaaaaggaagaaaagatgagacaaatagaaaacaaacagtgtcttaaacacaatacagccaactgcaataaatgtaaacggacttaaacaaattaaaaagcaaagatcgtaaaaaatcaatctgtaagcaagatgcaactatacgctatctaaaagaaagacattaaatgaccaataagttgaaaataaaaacacagcaaaatgatacaatgtgcaaaaattaatcataagaaaggaatggatacactaataccaaagtagactttagatagggaacattaccggcgataaacagagacatttcataatgataaagacatcaattaatcaaggagacctaacagtcctaaatgtgaacacacctaatgacacagctttcaagattttgcttcaaagcatatgaagcaaaaatgaacagaacagaaggaagataaactcaaaattacagttgaagatttcaacattcctctcttgataattagtaagtggacagaaaattagtaaagataaagaagaaatacatgtatctatctgacaaagaacacacgttctgaaaagaatgtgaaaatatttgaacagacacacaaagaagaaaacttctcaatggcagtcatgaagaaaatgtaaattaaaaccatgactttttacacccattagaatggcaattattttaaataaaaaaacagaaactaccggccaggtggtggctcatgcctgtaatcccagcactttgggaggccgaggcgggtgcatttgaggtcaggagatcgagaccatcctggctaacatggtgaaacctcgtctctattacaaaaatacaaaaaaattagccaggcatggcagtgggcgcctgtagtcccagctacttgggaggctgaggcaggagaatggcatgaagccaggaggcggagcttgcagtgagctgagatcgcgctgctgcactccagcctggcagacacagagaggctacgtctcaaaaaaaaaaaaaaaaaaaaaaaggcagaaactaccaagtgttagaaaagaggtagaggatgtagagaaactggaacccttattcactgctggtgggaatgtaaaatggtgcagtcactgtggaaagcagtacggcagtctctaaaaaaactacacatacaattaccatatggcccagcaattccactcctaagtacataaccaaaagaattaaaagaagggactcaaacaggtatttatataccaatgttcatagcagcatcattcgcatagttaaaaggtacaaacagcccaaatgtccactgacaaataaatttaaaaaaaaaaaaaaagtgatatatgcatacaatgaaatattgctcaaccttaaagaatcaaatttggatacatgctacaatatgaatgaactttcaggactgatatcgtttgaatatttgtcctgtacagatctcatgctaaaaatacaatccccaatgttgggggtggggtctggtgggaggcaactgggtcacaggcgcaacccctcatagcttggtgctgttcttgggatagagagtgagttctcatgagatgtggttgttcaaaaagggtgtgccacttccccaccctctctctcttgctcctgctctcgccatatgacatggctgctcctcctctgccttccaccatgagtgaacgcaccatgagggctccccagaagctgagcagatgatggtgccatgcttgtacagcctgcagcaccaggagccaaataaacttcttttctttttaaattacccagtctcagatattcctttaaggcaacacaagaatggcctaacacaaggacattattactatgaaatgaaatgtgccagacacaaaaggacaaaaatcgtatgattctacttatatgaagtacctggaggagtcaaattcacataaaaagtagaatagtgattacaggtggatggcgagagtaggcaatgaagagttactgtttaatggatagagtttcagactgagaggatgaaaaagtttcagagatggacagtggtggtggttgcacaataatgtgaatgtactttatgtcactgaactatacacttaaaaacagttaaaatggtaaatttggtatgtgtattttactaccattaaaaaaaaccaaaacactgcaatgggataccactacaaacctctcagaatgtgtgcaattaaagactgagaacatcaaatgctgacatttggagaattggaactctcatacactgctgatgggaatgtaaagtagtataatcatccggaaaatagtttggcagttccttatacatttaaacataaacttcccatgtgacccagtaattccaatttaaggtatttaccctagaaaaatgaaaacatatgttcacacaaagacatgcacacaaaacaatacctttattcacaacagcctaaactgaaaacaatctaaatgttcaccagaatatgaatgaactgtggtacactcatattgtatttaaaaatacaaaacaaacaaacaaaaaatctgtgataaacacaaattggatgaatctcaaaaacatgccaagtgaaagaaaccagacatggaagagtacatgttacttgattccgtggatatgcaattctagagcaggcaaaactaataaacagatcagtggttgcctggggccaagagagagaaatgactacagacaggaaggaactttttggaggtaattcaattgttctaaagcttgactgtagtagcagtgatagtgtatatatttatcaaaatcaataaaactgtacagttaaaatgggtgcatttcattgtgtatcaattatacctcaataaacttgatgtttttcaaagtttatgagaacctaatacagaagaaggtggcatcttcagtggagacacgatgccttacaagacagtcagctacccgagtggaagaaaataaaaggtagacataattcccaaaccatgtgacaaatgcaatccggatctaaaccatatcataccatatccaaaattatgctgaatgttcagatctaactttataaattaaagtcaataaaatcataaaagtaccagaagaaaatacaagagattggccaggtatagtagctcatgcttgtaatcccagcactttgggaggctgatgtgggaggacagcttgaggccagcagttcaagaccagtctgggcaacacagtgagatacgttttctacaaaaaaacaaacaaaccaaccaaagaaacccgactagctatagtggcacaggcctgtaatcttacctactggggaagctaaggcaggaggatcacttgagcccaggagtttgaggttgcagggagctatggttgctccagcctgggtgacagagtgacatcctatctctaaaaagtttttgtaatatatatatgagatcatatttatatcatctttgttagcatgctgaaactcagaagctataaaagatggacagatctgcctacataaaaactttaaaatttcacatgactagatactataaaattaaagataagtaataagataatatttgcaaaatataacaaagaattaaatgataaataaagaatgcttacaaatttaaaaaagaaacaacacaatagaaatggaccaaaaaaccagacaattgcccaggctatttataaagatttaaacagattttatatatacataaatcaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagctgctctggtcaaaaaactttggcattatcttttacttctccctttatttcccactttcatctggtctactaccaaatcctatggactctatttcgacatatatcaagaattcaaccacttctcaccaccctcactttgaccactctgtccgtttcagtcacctcttaatctgtactctaccaattggtctgtttctgcccttgtcccccttttcagtctactctcaacacagcaacgagagtgatcttgctaaacctaagtcatactttttcactactctgctcaaagacttccaagagcttcccatctccttcaatggtaaaaatcaaacaccttattatgatcaaaatatctgtaccctccattatctgtctctttatttcccatcatttacttttctaaagctacaatggccatacctcgagttcttcaaacacatcaggcactctcactttggggtttccctattcactacaccctttggctgaaatgctcttcccccaaatatccacatggctagctctctcatctccttcagttcttcacccaagttaccatttcagtgaagttttctctacctaccctatctaaaatttcccattaccctttcacctacaaacacttcccttatttgttttttctccttagcactatgtaacatatattttacctatctttatgatctctctttttagtattaaagtgccatgaaagcaaaggattgagtgggttttatacactgctgtctccaccagctcctagaaaaaaatgcccactacacagtaggaattcaagaaatgtttactaagtcaaccagatggatgtgtatgcagccaaccatttgaaagattcttataacatagttaagagaaaaaaataagttacatgaaatacaagttttagtacacaaaaatctgtacacaaggaattaacatgaaattttttaaaaatacaatttgcaataccatcaaaacataaaattcttagaaataaatttttaaagtaataaaagtagtacaagacctgtatactgaaaactacaaaacatgaaagaaattaaagaacaccttaataaatggaaagatgtcccatgctcatgaatgagaagacagtattaaggtagcaaaacttcccaaatagacctacagattcaacacaaatccaggtcctatcaaaatcccagtttcatttcttgcaagctaacactaaaattccatggaaatttgagaaacccagagacccaaaacaattttgaaaaagagtaagttagaatacccacatttcctgatttcaagacttactacaaagctacagtaatcaagagtgtgtgttaccaaaaaaacagacatacatatcaatggactatataactcagagtccagaaataaattattagattttgtcaattaaattttcacaatgacgccaagataattcagtggggaaagaatacttttcaacaaatggtgctgggacaactgaattgccacttgtaaaagaatacaattggatctccccctcacaccttacgtaaaagttaactcagaacagatactaggcctaaatataagagatacaactgtaaaactcttagacgagaacaggtataaatctttacgatcttggattaggcaatggtttcttagataccaccaccaaaagaacaagcaacaaaagaaaaaaaaaattgacttcaccaaaattagaaactgtgtgcttcaaaggaaaatgaaaagacaatccataaaatgggggaaattatttgaaaatcacatatctgatgagggacttgtacccagaatatatttcaaaaactcgtacaagccaacaataacaaaaatttaaaatggcaaaagaaatagttctccgaagatggccaatcagcatatgaaatgacgttcatcaccgtaagttgtcaaggaaatggacatcagagccacaaagatccttcacacacacaagaatggctgaaataaaaaggacagctgtgttaaaaggaagtagagaaatcagaaccctcatacactgctggtgcaattgcaaaattagggcagccactttggaaaagagtttggcaattcctcaacatgttaaacacggagttaccctaggaacccagcagtttcactcctagatatatagccaagagaactgaatatatatgttcacataaaatcttgcagataaacgttctttgcaacagtattcatgtcacaacatgaatataccttgaaaataccatagtaaataaaagaacctgtacacaaaaggacacatagtgtatgattcccatttatatgaaatgtccagaataaataaattcatagagacaaagcagattagttgttgccaggggccaggaaagggaagaatggggaatggctgctaacaggttaggatttcttttggggatgatgaaaatgttctaaaattcgatagtggtgatggccgcacaactgtgaatatactaaaaactttaaaagggtgaattttatagtatgtgaattatctcaataaagctattaatagttttgaaagttagagaatatgtttggtatgatttttttttaaacaccgcctccccaaaaggaaaaaagctgtatgtatatcagtacctttacagctatcttacattttatatttgattggtaatttccttccaagcatttctttccccctacatttaaacacatttaacaactgttaagttttagaactggctatgaagggaagagaaacatttcatttcttcttatacttaaaaaaaaatagctttttatttttcttttctatatttcctcatcctcaaaaatagattctacacaccaatatttgagggatggtggggcaactaccacaaaatacaagaggctgtcttttggaaatgtaaaaatgttagaattcctaggaacttgtcttgatttatgggactaacctaatatttaaaactgagcccatgctggtaaatctgggctatacagtcatacatacatagaactgtggtatcacaacacatccactgtgcactggaagagtactataatctccttataatgtgcaccttggctctcccctcccttgcgttctttgacatttttttttttaaataaggcatgtttatttcttatttacctactaactacagaaggtagactcacgatgtgccaatattaaaatgttattccccattaaaatacatttacttaagtgttttattacatgacttaccagcaatggaagaatctcatctgagagtagttctcaactgtcatctatgaaaatctttagaaataccaaatcatcagaattactttaatttcctggcttttaatcataaaacattcctactggtcaacaattctacaatctgaaaagagacatctgtaccatatagtcccaatgatttattattctgaaattttcctctgggttatttttacactataattagagttcaaacttccatagtgcctagcctaaaattaaacctagaattatgccaatttatgcctgctatatatgcacacacaaaagacttataatgcaacatactgaaagaactaaaggtaggtgggtttttctttgaaggaatcatagctacataatttcaagtttaatctgttacatttatctgcctgtaaacatgcctgtagcatgtaaactcataaaacgaaaactgatttagtaacaaaaaaaattagcttctaatttaacttcaaaatgcttttcaaaaaatcgaccccatctaattctaagtgaactagaccacacttgatagaaaactgttgttctaaaaaccatacgtacttaacataaatagtaaacatacgagaacatttagtcttctattaatgtcttacaaaatacttcaatgtggcctagcctggttataatttttttctttttttttaagggacagggtctctgtcaccgaggctggagtgcagtggtgtgataatagttcactgcagcctggaactccagggttcaagcaatccccccccacctcaggctcccgagctgggctaattttatttttcatagggataaggtctcactttgttgcccaggctggtctccaattcgcggcctcaagtgattctctcacctctgccttacatttccttttgagctgttattatcaactggagtaacatttctagttgggggaaaaaggaactgatccttatcaatctgtagatgaatacttattcagcacttacaaataactgaatgtgggcatgaaaaaaagaatgacagatgataaacatttactgttctcacagaactatcaaatacaggaataagtaaattacctaatttcagttgagataaatacgactcagaattcaataaacagtataaggtgaggatgctagaaatgcccacataatgctgacaaactacacattggcatatccatttaagaaaagaatttaccaatatctagtaaccagcaatttcacttctacggttctttccaaaacacctgcacatacactcacgtaaaaataaacactgcagcattgcttataatagcaaaaagaaaacaactcaaaatatccatcaatagtgggatacattttatctatgcataaaatgaagtgccagacaacagtgaaactgaataaactacatctacatacatgaacatatacacctcaaaaacttgatactgagtttaaaaaaatcaagctattgaaagacagtgctatacatatctgtaaaaatttaatacaaaaaccaccaccacatatcacttatagatacatgtacacatgtatagtaaaagtataaaacaaggatgtgaaatatacttaagaatctcaagacagttgttactttgtgtagagaggggtaacaggacttgaacagttggggttgttaaaagtcattatgtaactggcatcctttcccccaagggataaaaatggacataatttacatttatagctggtggataaatgggcatttgctatgttgttttctggatgtttttaaaactttacaattaaaacatatacacttattttaaaaacaaacaaaagacacattagcatataatgtccaagctgatatttaccttggaagatcatctaatataaacctccctacttcactaaaaaaaatcagaaaagatgtcagaataaaaatatgatacaggctggacgcagtggctcatgtctataattccagcactttaggaggccaaggcaggaggatcccttgagcccaggagtcaagaccaggctgggtaatatagtgaaacttcatctctacaaacaaaacaaaacaaaacaaaacaaaacaaaaccaaaccaccaaactttttagtaagaatgtaatagggttggtgtggtggctcatgcctttaatcccagtactttcagaggtcgaggcgggcagatcacgtgaggttaggagtttgaaaccagcctggccaacatggtgaaaccctgtaactactaaaaatacaaaaattagccgggcgtggtggcacacgcctgtagtccctgctactcaggaggctgaggcaggagaatcgcttgaacccaggaggcggaggctgcagtgagatgagatcgcaccactgcactccagcctgggtgacagcgtgagactctatctcaggaaaaaataaaataaatacgtgtgtgtgtgtatgtgtgtatatatatatgcattatatatatacacacatatatatatgtatatatatatacacacacacacatataaaatacatatataatatatatactcttgtagcagggcaattttggacagatactaggttatctggaacagcactttggggaattagatcctgaccatttaagagagaaatctggtactgactagcaatatggacaatgtgtgcaccaccctcactccccctcccctcctaggaatgccatgtcaaatttagcacaggcataggcagtaaaactgacccctagttctgcctatcactatttaaaattactttcagttctgagtgtagaggactgtccccacagcagatatctaaaagcaggcctgaaagaactagaaagtagttcattcctcctaaaactgtacatgaaaaaacaaaattaaaaaatgaactgagagcaaacatttatgctctcttataattttcaatccaggatttaagaaattatttaacatcagctgagacgtgaccaacctattctccagttgagatccatctatttttaaattcactcccccacctttcattcagcctaaaagaggaaataagaatgggaaggtggggaggacttatcccatactgagttaaataagaccacaagatcttttcatttttacaatatttgaaatacagtacactgagcaataaatttaaagaaatatacactatttgaaatgcataaatgttgctttatgtgtataaaagatcaaaattagctcagttcttctaatacactacacttaagcgttcttcgatactatcgtcaacttttcagaaatattcccattctgtgaagcaggatgtattcctaccttattcaccagactttatccacgtaacttcctattctcccactctattctttaaacatgttcaacatgttacagagatggcaaaatgtgttaaaaaagggaatgagaatgaagcagcttaagtaattaggaaaactttataattcttagaaactgaatttggatgatctttaaaaaaaaaaaaaaaagaaaagaaaatctgctatttgagatgaagtgtcgcctgcccaggctggagtgcaatggcacgatctcggctcactgcaacctctgcctcccaggttcaagcgattcttgtgcctcagcctcccgagtagctgggattacagatgtgtgccaccacgcctagctaatttttgtatttttaggagagacagggtttcaccaagatggccaggctggtctcgaactcccgacctcaggtgatcagcaggcctcagcctcccaaagtgctgagatcacaggcgtgagccaaggtgcccagcctaaagagcatattttcaatcaccaacacacaacatgactgctgacttcagaaaactaggaaagaaaaacgttacccaattaatcgttgtgtgaaataggatttatccattagtatacatatcacatacaataggtgcacaaaagattttttccattcccaaaacaaaaacttaaaatatttaacaaagataatataaatatccttatttatagcacattgtaaggttatcaatattggtgcatataaccacagaggcacaataaatagaattctgaggaaaaatgtattaagacaataaacaagctggaaataacccctatttccccttatgacccattagctttatatagaaaatactgctgtgcacttcatcctttgctttctaaagaacagcattatggttcacatctgttaagagacagaaaagtatttgttggaagtatgcaaggaagaaattcctgtactgttacgtgcagtgctaaaggaatcatctgagaagaaaataaagaacatgagtttaacatgagctttagagagggaacaagagtgcaagaaagcgacaaaatgtgacatatgtccatagtgaatacatggtattttattttcagtatttgtatatttaatttggaggtggaaagattcagaatttattctgcatcacaaagattataaaaatatatgagttggggtgttggctacagtacacaaaggcaattctaagacaaactattaacagaagcttgaaatggataagccatcccttctgctatgagacagaagtcattacacgaaaagaatctgtgtagaagcacagcaatggtagcatcttcattcagcccacagctgtgtaatttgtgtgcaagagtgcttgtcttaaacatgaaaaggaacatcctgaattgctgaaagtatatacaacgggcacacatccagaactagaaaagacctaccaagcctgcatgctatgaagagataggtcaaaaaatttttctcatgtttggtttttataactaaagtctgtgctagactaacctcaattgatcctgaggggtacagatgaacttctggaacacaatgaactgttaagagtcacagctttagactctacactgtccagccaacagtttcaagaaaaattttatccttcttgtatgagtgttcagggatcatatactacctctatgctcttacttgaagcacagatacagaccttaataaataaagtcttacatcagactgtcttctataatcacatgtgattccttacacgagattcctgttcagatttcctgaaaatgaactataggaataatcttatccaatatgagtctatgtcccctaaaaatctcttttcctttcaggtcaatcttatgattcacttgccatagatcagattaacacaacaggtctgatacagcaaattacaaaagagatttgacttttgattaatacactgaataacgtaccacaaactattaagatctattgtccatgtcaaatggagttcacatattcagaatgaattcacacactaaaaattttccaatacaaagtttctaaaaagttttttctttttttgagacggagtctcgctctgtcgccaggcagtgggtatgatcttggctcaccgtaacctccgcctcccgggttcaagtgtttcccctgcctcagcctccagagtagttgggactacaggcgtgttaatttttgtgtgtgtgtattttagtagagatgggatttcaccatgttggccaggatggtctcgatctcctgacctcgtgatccgcctgcctcggcttcccaaagtgctgggatgacaggcgtgagccaccgcgcttggcctctaaaaagcctcttaatctacattttcaagaatgatcacatttgaaaagcatactcttttaaaacaaagcaactatcaccttcatttgacagaaggaggaacaaacgcttcaaaagctaaataacctgctcatgaccattaggaagctatagttaaaacaacctcaagaccaacctccttcctccatttcaatgactctgacacacttaaaattttataaataattttagggattatcagtcataaggcttagaatcaaatagtaacgactcatgtacaaagaccagtatttttttaaaatgctcagctgggcatggtagctcacacctgtaatcctagcactctgagaggccaaggggcttgaggacaggagtttgaaaccaacttgaacatggcaagaccccatctccacaaaaaataaaaaaattagccaggcatggtggcatatgctaatctcacctactcaggagggtgagatgggaggatcactcaggcctgagactgcaatgagttatgacagcaccactgcactccaacttgggcaacagagcgagaccctgtctctaaacaaataaataaaattaaacaaaaagaaatgctttgggaggccgagacgggcggatcacgaggtcaggagatcgagactatcctggctaacacagtgaaaccccgtctctactaaaaaaatacaaaaaaactccccgggtgcggtggtgggcgcctgtagttccagctactcgggaggctgaggcaggagaatggcgtaaacccaggaggtggagcttgtagtgagctgagatccggccactgcactctagcccaggctacagagcgagactccgtctcaaaaaaaaaaaaatgctaactttatttcactctcagataggcctaataattaataagcttctttttgaattattatccataatggcatttacctgttacagataactcacatcaaagcactaagcaacatttttgagagcaaatgaaaacaaaagctgccaaagaagctgtgtattaataagtcatttcattaaaaaaaaaaaaacttgccaggtgttgtggctcatgcctgtaatcccaacacactgggaagctgaggtaaaagcctaggagttcaagaccagcctgggcaacacagtgagaccctcatctctataaaacaaaaatttttaatattatctttttaaaaaggacttatttatatagcatctttaagtatttcaaacatttcatgtttggattatggggtatgtttctagaattaacactatttctatttaaggtaattttacatcatttcctttattagaaaaaataacagatctgtggatggcattttgtgaaggctgccttctattaatagtgtataaaacagtcatgtatctccaaaacggtgggtgagtaatcacaaagcaagtgtaactattcatcccaaaagggaggacagaacatgtgccaatgtgtgcagagtcctgaactagagacttggattctagttctggtcctgacacctgggtgtctttcagaaaatcattttaaagctttgcactccaatttcctcatgtataaaatgactggagcagctgacctcatagacaatcctacttaggtagcatctatcaatgtattgccagaagacagaatcataatcatgccccccaaaattagagtatttgaagacaaccgccaaagtaaaaattttaaattcttttttattttttttaatttttattttttttgagactgagtctcactctgtctcccaggctggagtgcagtggccagatctcagctcactgcaaactccgcctcccgggttcatgccattctcctgcctcagcctcccaagtagctgggactacaggcgcccgccaccacacctggctaatttttgcatttttagtagagacggggttcaccgtgnnnnnnnnnnnnnnnnnnnntttttagaaactttgtattggaaaatttttagtgtgtgaattcattctgaatatgtgaactccatttgacatggacaatagatcttaatagtttgtggtacgttattcagtgtattaatcaaaagtcaaatctcttttgtaatttgctgtatcagacctgttgtgttaatctgatctatggcaagtgaatcataagattgacctgaaaggaaaagagatttttaggggacttagactccttacacacacacacacacacacacacacacacacacacacacacacaaatactaatacactacatgccagatactggggtggtgggctgggaccaaggcatgaagtaataatgcatgtgccaaagggctgaactttttaaaatgagtacaaaagtaaattttcagagtagcagctggtgggtaggaggtattgagtccacagaactgctcttagattggaagggcatgggagaatgaagttccattatgtgatggggttttacacacacacacacacacacacacacacacacacacacgcacacacacatgaatgtgagaaagtcactcaattataagcattcaaaaagacagacagctttcttgtctttgtggcgtcagtacctagctcagctcatagaagccacaggaggaacctaatcaatgttagttgatcatttactgatttaccaataactaattcatgactgctctagtgctgtggtctgaatgtgtcccccaaaattcatgttgaaagcctaaccgccaaggtgacagtattaacagctggggcctttgggaggctttgccctcattaatggaattaatgcctctataaaagaggccctatagagccccctctactcttctactacatgaagttatagtgaaaagacagctagctgtctatgaacaagggaagagggccctcactaagatgtcaaatttgtcggtaccttgatcttggttggacttctcagcccccagaaccgtgagaaataaaacttccgttgtttatacgccaccctgtctgtggtgttttgtaatagtagccagaacagactaagacatctagtaacgcattctctggtaaacactaggaattcctggccttaaagagttcatagctaatgagaaaagaaataaacaatataaaggataacatgctgtagtccattatatacaaagtgcttccagaccattcagaaaaactggataggaagatttctaaggtaatacttattgagtgcctgcgtgttaggcgttttacatactttaagcctcacaactctggggaagtttcaccaacccattttacaggtgacaaaactgtggcttaccaagattaataaggtcagaattaaaagtagggtctaattccaaagacattaccactatacataccaatttgtcttgttactacattttatccttacatttggcagtgaggggaaaactcaaaaccagtcaaaaaaacttttgtcctgaaccagcataaaaagagcacctaagacttcatccagtattttactgaaagatcacttctaaaagtttgtcttcaccccgatctaaaaattagaaaactaattttctttcagcagctgcataagtacataatgtaatgtttctacatttagacctatacaattataggtctaaacaaaatatgtgtaacacgattggagaacattagcagtcatttaagaaaatggacatttggaaacatcattttaagagcttgggatgaaaaactttgctatgacctatacatctggatcattccactgactgacactgagagaaacagtgtattatcacagtttacacagcaaatttttttggaggggagaaggaggtgattgaaatagaaatgatatgaagtttaagaaatacaactgattagatgtcacatgtcaaagacactgtaggtacccaataaatactgttaaatggactggacaagtgggatgagaacactttttccccacacctctgactagtacgtgcctttcttaggaagttattttttcagccatgaaaaaaaaagggcagaatttaggacagataaaacacaagtagcttataaatcctctgaaaggaaatcaaaacacagtattttgtatctctgtataaagttaagctcctcagggacaggggcaatgtccagaggatggtgagcatactacttagcaaactaatgcaggttaataaatattgacacagtaagacttgcatagtttacattctaattttgtaaagattatgagttacctcttcatattctgttcttgtatttctcctgtgtatattataaatacacaaacattgcaaattattttttgaagctatttcatttttggtcaagactattagcgtttcttaaaagggtttctggtcatccttagggtttatcagtcacatcattaatattgtattcatttcactaaaaatgtggtaagtagcttagatttaaaaacaggatctaatttcaaagctatttccactatacataccaagataaaactttcttctctctcctaaattctaaatttcacatgatttaccaaatcacctcttaagagtacttattggtcagcagtgtgagacaaacacttaccccacttgtccaatgtattccacaagattgactgggtacctttgtgtctctgacaggtaacttccgacagttgtatttcttaaactttaagtcgtctcccaaaaaactctgtaatttgctgcttctctcaatattgcaggcagtgaaatgatccaaaattacgcgtcatatccatattccttcatgattgaggttaactatgcactgcaaaccccatatgctattactttatattttcagcagcaccctagcctcttaataatctcaaacagattttgtactgttactaatttagcacatccataaaaagtcattaaaaaaatttagacgctaaattctctttcaaggttgccaagcttcaccactgtattaaaattatttttaaaatttcaaggactaaggcatttggtacattcaattccacctttaccaacaaaagcctttatcactaagatgaggaaagcatccttttcattttctccagtgaaaagggggaaaaaaaaaaaggccaactgcttgcatgcaggtctgcatataacacagcagtctctggcaaagccagtaactcacgttcaacttcagaaatcctggtggacggcaacacatgagtaatctgtgcgcacaacccttgggcttgacataccacttcctccgccctcccttcccatcaatccacccccaaaaccccaacccaccaagcacacggctaaatatgtcttccccaagagagccagaaacctcgaaaacgccgagaaagagctccccttggaaggaaagggcctgcccttcccagtccggggccccggctggctcgacaagcctctctccgaggaggcccaaatctcgacgcctcgcacgtccagccccgccccgggcccgctcgcgtcccctcgggcgacaaaaccctcccgccggcgctcagccaggactgacagttaagactgcagcagccgcggccaccaggggcctacttctggcaccagcccctccggaccacgcgcccccaaacactcgcctcggcggcggggggcggggaagcggggcgccgacctcgccaccgcgggccccgaaggccggccgagtgacggaggggagccagcgccgcctggcgcaggccgcggcaacactgacctgtcgtcgcccccgcgcctgggctgcggcggccgcctcactggtcgtcgtcgccctcgcccgccgcctccgcccgccaccgcctcgttccctttcgctgccgccaccgccggggctcatgcgggacccgcgcttccttatccggaaaacgaggccgggaaagggggcgccggagccgccgaaattccggcgttcgtcgccagccgccgctgcctgtccacaccgggggctgcggggccctcctgccaggggctacaggccgcgagctattccgaggaggagccgaaggaggcgccgccgcccgcagcagagcgcgccgggtcggcagaggtgaagcgtaagtaggcggcggatggcgggcgcccgggctggtggatggctacgcggcggaggggtgcgcgagcgagcgaagcctggtgtgtcgggtcctggcgaagggaaaaggccctgtcgtctcctgtagtcaccccgagcccagcgccaccatcttgggagaaacacggatct

SEQ ID NO: 3 - DNA, 113476 bp, Mus musculus
atccagggcaacagggttacaagacgtccgttgactccttggggggctcttgggtgacttccctgaggtcctcagatgcccttgccctgtttcccataagaggaaatgtggacatctaggatgcacattggttggcaaacattccattccaacaagcacctagttctacattctactcttgggaatttctgcaaggcctgcccattgctcatgactgtcttttctggtcttttttgcagtcatatgacatgccaccttggaaagcagagaaccacagatatcaggtatgtggaaagatcatggctaaagcctccccttccatatgcccaggcccttcatgttttggtttcaattctgagccaatcggcccttttggaatttaggaataagaaaatagtatgcaatcaccaaacgaagctcgatttaggctatgttctcccatgtagatccctagtttgcaaagttttaaggaatttgttcaactcctgataatagatttctcataattttgacctacttctcatggagagaagatgacatttttagtatgttgggatctcatacttggattcttatgtggccatggtgaataggtacaggatgacaacacaagcctccagggccatttaggactcttcctttcccatgacacagaaggcccaagggacagagcctttcttagggagagagaaggattctatgatatccaacaaggctggcctccacatgaagtgttcacaaagagcaatccctttagcaaatattccaaagatttcaacccacagggaattcacccatgtggagagggtgagattttcatttttgccttggtttccaccaccttccaaattttcttcatggtatcatttggggctcttactgaacctcactgcagaatcactgaggaaacaatggcctatacattcggttgatacagggaaggccaggtgtaaaggaacttaattccactttgattcatgacaccaaggcccaaatttgatccagcagtagtggttaccttcatgtgttagaggctgggcaacccattacagcttaacacaaatggatccatggctagacatttgtcctgtgccctaggcccaggattctcgggagattttcagtaatcacatttcacagtgagtgctgtcatgcaatatagagcttacagagttctgatgccacctttgaactttgaataagaaaccattggttactttaatcacactcgaaatacctatctgtagttgtgttttattgtcctgtccatagttctttgggagctcaacttgagtgttgatccccacaaaattgtgaggctaaggtcacatgtgatgtgcctattgcttctagaggaagcagtaaagctttgttggaattccaggggtcctttgtgcttttaattaggtttctctatggtatgcatgaaaacttgtgtgtgctgggcctggttttagtagaagaggcagccacaagagagtttctgcacaatggcgttctgagtgtttaataaccatacttggaggctaatgttcagaggcagtgaatgggagaatattttttcttggccctccaaggtcattaagtcccaaaggactgtgtgttatctctagaaatgttcacacactgtataatgtcacccgtactcttgttctaggatgctatggtgaccccactaaatgaattctaaccctttgcatgatacagatgctttgcatcttttaattttgattgtggcctcttagagagattcttttctgggacgttttaagcaatactctttttacactatgcttcttcacaccttgaagcactttagaaagatttatacccaaaaacttttaaaagcagttcaggtgacccctaaagggaggactaaagggccatgagctattcatccctcttcttgacaccctagggtgcagaactaaagagctggactgaaggcttctttgtataatcagtaatcagaaaactttttttaaaaaaattaggtcagataacatcttttggggccaatttgattctttggctgttgtagtactccaaaactaaagatgactagatctgactactgctaaggataggatttgtgccctacttcagaaattatactggtgtgagatggagacaaaaatccaatggcatgcttcctcctatggatggccatttgattcctgcctactctggctcctctcctttgtcatttttatcttaattttcaaccatgccaatatttctaattacaacacaaaatatgaatcctaaaattttaaggatccaagtcattttaagcacaagtatctaaatatctatataacttataataagatactttaaatcacaaatgtatgacatcattttgttgttttcaaccacagtgaaatgtcacataatattgtgttaatattaacccacaataataataatttaacaccatgcaataataaattcatattaagaaattaatctggacagatttcatagcatgaatttggataaatttttaaggaaactgctctgacatattttcctaacttttaatatgtttaataggagtttctaaaaatgtttatttctaaatagtttgaatatataattggtgtatgagttttcttattaattaaatttgttctttgacaatttcatgcatgtataaaatacattttaataacacttatttacctcttccccctcctatcattgtcaacccaccctctttaccacaagcctctttcctgtgtttatatctttctgttttgtatgcaactttgctttgcaagggtcatttgtgtatccatagacttcagaattatccattgtagcctcataaactcatggatataaaaataatgactctccttccaccgtatacatcattaccaatagtttagcaaaaggtaggtcctcatgagtcctgcccccaaccatagatggttataatagttccagttttatacagaatgtagatagccactggtactatgagctaatagttgcagtagattcattacatctaggagaaagtagttcataggtcttatctcaatctcctggttcttacattctttttactcccctttatttatacaggatggtataattacccctttagaattgagtacttaactacctgttttgttttacctgttttgtttacttgttttcatgaccatgcatgcttggtaacaaacaaccaagaaagaaaaatatgattaaaggtcccaaattgagatgttatataacacaggacataaagcagtactcaaccttcctttctgatgctgtgaccttttaatacagttcttaatgttgtggtgacacccaaccataaaactatgtcactactacttcatacctgtaatttttctatcattatgaatcagcttgtaaatatctgatatgcagggtatctgatatgtgagctccaaagaggccatgacccacaggttaaggaccactgacataaacggttctaatacagaatgtgtgtgccaaaatatagaaatatgaatggtatacaacatatacttattattctcatgtaattgaaattttctttgtttagtattaataattacatctttatggaattttcttatgagtgactgtgtgtgtgtgcacgtatgcatgcaggggcggggcatatgtacatgacagtgacgaagaatatcaggctctcagtgtttcttaggtgctgctgaaactgttattttcttaaatctgtagtaaacacataacttaagaacataatattataatatttcacttatatttcataattactctctaagtatatattacatatgctataaatctaaggtaatttgtaggcctagtgaaacagacatcaataagcctaatgcccttggttaggatcaggaatagggaaaacatacatggcaagaaatccttcaacctttattgaaagaacttacctattttttttttataaaatagaaatactggatattgtcctgagttgcctcttgtaacacagtctattgatgtgaacatggcaataatattgtattccaatgtgaaaataattccttagtttactgagaatatatagagatgtttaccattagaaggtttgcattaggttattttggtgttcatgtctttttgttccagtcatttaagtgataaatgcagaaagtttaatcttgtagcaatatttattcctcttactttttataaatgtcaaattgtcccctccaaaactttctttcccctattatcatcctactacaatggctcagctaaaggtcattaaattgacctattcctagctttgataaactaaaaactattttgcatttttaaatatgattttgaggctgagtgtctatttcagagtctgaaagcacacctaatcttgcgcgcgcccaactggccagaaagaacgacgctgcaacaggatccttctgcacacgtttattcagtcctgtttcttcattctctatatctcccttgtttatatctcccttgtttatatcttccccttgtttatatctcccctctcgaataataattcttcctctaacccgggcctctcactcttatatactctcagccctcatccatgcacagcaggccacgccacctcaccaggcacgcagcttcagctaatcagggcagcaggggcatatctccatcaaaatggattcaccagtatcctggtacacctgtgcagctctcaagatgtttgtggcttatatgaggaagtcaggtgcaagccatatgacttagctgcagtccctggagccttcttgggattgcccccacacccgctcctcacaacctaatatgttccaagccatatacatatacatgtacatgtacatgtacatgtacatatacatatataataataactgtcttttctttactgtcacaatgaataatggcacatgaaaactatgaaacatttgttgaatcaggtaaataaataaaagctactaatgttctctttctaattatactttcacaccttttgactcaaaaaaaaaaaaaacccaaaacctattttgcaaatcctggcaatggaactgtagtaaattaacccagttatagaagagctaacttgtcaggaacaggattaccaagatcagtgataaacaaaatctcctaaagattgagaattatttcatgatactaatctacatgccctttgatagcaaaataggatttccagaattatttaaatgtgatatcctctttactaaaaatgttcctacataataatttcctacacaatagtttccttactaaatttcattatcaaaatggctccaatgggcagacattagccttaaggtttcacattaaggagaagtttgatattttaattactgtgaacagtttgatattggttacatccaagtattgcgtgaatacttggttacagaaatatatagaaataaaacatgatcaactggtaataaagatgaacgtaactatcagtaaaattgagaaagttccatgggaaaacagatacaaattatacctaaatacaactgtattagtttattataatagctatttattcttttgcaaattgatttctttaatttttgcttttgttatttctgatgaataaaatatcagcattagcatcatgtttagagagagaaatcagcatattcctttgtcattacaagttgttataggctaagatgatcataaaattagttgacacatttaaaatgagtaaaatgtgtatttatatatgatgcatatatattaaatatatgtatatattttatacatttaaaatgagtaaaatatatgtgtgtataacacatatatagtaatatattaccatatataaaataagtaaaatgtgtgtgtatatatatatatacatgtatatgtatatatatatataaaatatcacataggtagatgatagatggatagatagatagatagatagatagatagatagatagatagagaaaaagtgtgtttaagctaacacactcagaaatagatgaaaacctagaaactagggtaaagattaacggctgaactgccatttatacttgctcaaggagataaaaatcagctttctccagtgaagggacactggatatatcaacctctcaagggtaggcctcatgttcagtagtagctgaccaacatataagagactccacagtttttttgtgtacttgcatttggttacagattttatttttctttttgaggtattgtttcattttgttttctcagtttacaatggttgttgtattaattttttttgttggtttgtttggtctttttttgaaggaacttaaatttgagtgggtgggtaggaaaggggaaaggatctggaaggatatacacaaaattaaaaagaactaatcctttaagaagataaataacgctaacaaaatgaatcaatgattttaaaagatacaaatacatatatgaagaaatatgagaaaggatactatagattatatgtatattaaataatagtaagagaaatttatgaatgtgccaatgaactcagcaatttaatgaagtaaatgaatgagttgaaagattcaaatataaaaatttatttagtacatagataacagaatactgttttatcaacaaattaaatccttattgaaaacattcctacaaagaaatatagattacacagaattttaagattttatcctcatatcaccttctagaagatataaaaaaggaatagtgccaagctcaatatatataaaaaagtaacaccttcatcaaaaaatgctacatttaaaatgaagaatatacagcaatatttttaatgagtatagatatatatctttggtcaattttttataaaatagcatctaacaatatgcagaaatatttatgattaaatcaaattaaccattgaatgaaatttgttttacaatttcaaaacaaatctatatttaaaaaatcactagacagtcaaggtaataaaaacattaggaatgtatccttccataaaattactatttacatgaatattcaaaataagccaggtatagggatgtacatgcaatctcagcactgagaaagccataaagcagataaatgtttatttcaagaccagcttgtacaacaagtaagaccttatctcaggcagaagtcaaaattaatatttggaattttgtaaattaaccaaagacttaacaaaattacaaagaacatttatgcaagaaaagtgtctggctctcagtttacaaaaagcagaatttgtgttacttttaacatgtctttatttcatactcctccctgagacactgtggtagcattgtaaatcagcaaaatagaagccatgagagaagaagcaaagatttgtacccccttcccatcctaatccccccaaaataactattttgacctgctaagcagttctgtagaaaaatatatcccatgatatttttagtaatttgggctgatgcagaggcttatgtgtgagtaaacccccataccagcattaagcataactaattaatataagttattgaataccatagaagataaactagttaacagtagctgagataaaaatttttaaaattatgaaactgtaaaaacaatctgtctggtaaagagaaattttgtggtataatcaggagttctgtggaaaatgttaccacactgcttttggtattgagtccacatcaatattcagagtgcatggtagcatatgaaacatatgaagtccctagttgcttacttcttaattatcactaggccctgtgtaagtagtaagttatggctaagaaacagttgtgaactacctgaataccacatgtgaaccaaaatacacatacagaacatcccttaaaaataatgagtgacatattgtttaaagttatttaaagaaatctctatctaatcattgcatgtgcttaaaatggaaaatacaattcagtatccacatacaacaacacacattctttatgaacaaaaataatgaaaaagaacagatcaaccgttaaaacaaactctaggaatgataaaacatattttcatgcatatacattatatgtaaaaatgtccagtttcaaaatatatattgtcttagttttggctttattcccatgtaaagataccatgactaagacaactcttataagggatatttaattggggttggcttacaattctagaggctcagtccattatcatcatgccaagaagcatggcagtgtcctggtgcagaagaaagagccaagaattctccatcttgaactgaaggcacagacaggaagaatgtctcttccacactgggaggagcttgagcaccagcagccctcaaagcctgcctacacaatgatatacttcttccaacaaggtaacacctattccaccaatgctgcatcccctaattttgccacttctatgggtcaagcatattcaaaccactatatgtgtgtatgtgtatgtgtgtgcatgtgtgtgtgtgtaagtataaaaataagagattaaaacacatgtacagaaaaagatatcaatagaaactggaaacaattcagatgccctcaaccaaagaatagatacagaaaatgtggtacatttacacaaaggaataccattcggctattaaaaactaggacattatgaatttcacaggcaaattgatggaaatagaaaatatcatcctgagtgaggtaacccagacccaaaaggacatccatggtatgtactcactgataggttaatattagccaattcgttcagaatatccacgatacaactcacagatccaaagaagttaaacaagaaagaaggcccaagtatgcttgaatcccctaaaaaggtgaaacaatgcagtaagagaggttagagggaaggagaaacctggctcagagaggggagtgtgaggggagtgaaggggggggcaggatcaggcaggaggacagacaggaaagaagcccagagggccaggagagtcagtgaaagtatgcagctgccaggtgttgaggttggaggattgtctaggaagtcccagagacctgggatgagggaacttcctgggaatcaatgcagacaaccttagctgaaatgccaaaaaaaggggaataggaaagctgatgagacaacatccagtagccaaacaggactcccagtggacggatagggacactaacacacccacaaaactttagatccaaaattggtcctatctaaaagaaacgcagggaaaaagatggaacagagactgaagtaatggccaactagtgactgacccattttgagatgcatcccatgagcaggcaccaatccctcatgctattaatgatgctatgctgttcttgcagacagatctgagaggctttacccatcagctgactgagacagatgcagatacccacaaaaacggaacagaggttggagaaccctatggatgatttaggggaagaattgaaggccctcagtgaggtggtagtcccatgggaagatcaacagtgtcaactaacctggacctttgggatctcccaaagacagcacaaagctcccaaaggcagctccaatcaaaaaagcacatacaggctgatctgaggcccttggcacatatgcagcaaagggctactatgtctggcctcagtgggagagaaaatgtctaatcttgtagagacttgatgcccgagggtggggcctgaaaagggagggctgctctctcagagatgtgggggaggggaaatggaggggaaactctacaagggggggggggagtccaggagagagagcagcatttgacatataaataaataaataaataaataaataaataaataaataaaagtattcttaaggaaagaaagatgttggacctactagacaaaggcagtaagtcaacttttaaaaatatattcaaagaactaaagaaaatgaggaaatatttacataatatatgaaaatgatgcttcaagaaatatagactaaaaaacagtaagaaatgaccacatgaaaattacttatgttaaaaaagtaagtgtgtaatgtgtatgtagtttaatgggagaaggcttgaccagcatattcaaagccctggcttccatctaacactgggaaaaaaccaacagaaatatacatgatataaagaactctcaataatgaatgtcagcagaccagatattggctaacatgaatatgctctaagtaagattatctagtcaaagtacgaaacagaaaggaaaaaaaatagctaaaatatagaaaaataaactaaacaaaatagagccatagcaaactgcatttatatcaacttatacattaatgtgagtccaagaaggaaaaagagaaaggggaaatttttaagaatgatggctcaaggggctggagagatggctcagagattaggagcactgactgctctggaaagaagtcctgagttcaattcccaccaaccacatggttgctcacaaccatctgtaacgggatctgatcccctcttatcaaagataacgacagtatactcatatagattaaataaatctaaaaaaaaaaggatggctcaaaactttccatatatatataaaaccaatgtaccaaacaagaatataaataagcttcaaataagataaattcaaatgcaatcatataattctaaagaacaaagcatagtagtgaaactattgaataattaataaaaagagaatgtgaagaatgtgtaaatatcaacaacacgctcttcatcataaactatgcagacgagcaggcaatataacatatattataatattacaatataccataatgaaacaatatttaacaatttaacatctatgaaaatacactcatattctcatcaataggtataatgtccagacaaaaataacagaaaaaattcaggtttgaactgcatcatcagcccaggatgaaatgaatggataagctgctgaggtctatcagataattaaagagtcattatcgccaatatctccaaaattattctctaaaatataaagttcatcaacagtaacataagttatgagtacagtattacattgatacaaaacttaaataaaaatacagtgaagaaaaaaatctataatgcaattgttctgaggagtatggatgtaaaaattcttaataaaaatgcttaaccaaatccaaatatacatcttaaaagatcacatactaatacaaaagttgcttcattccagagataaaaggataattcaacatatataaggcagtaaatgtaacaaacatgcacacatatgaaacatagatcaaaggacagaaattgcatgatcattgtaataaatacagaaaacagccttagaataatgaataactgttcatgagaaaatactccaagtaaactatttatggataaaaagacaataccttgatataataaaggccataaacataaaattatagcaaacgtcattctcaatgggaaaagaactgacagcatcacttacaaagttgggaaataagtatatctcgtctctccacttgtcaatataatgcttaaattattcacctaggtaataaagcaatggaaatacagggtacattaagtgaaataattcaatccattcctattacagacaatatggacctacactcactgggcactaaaattctcctcagacaggaaaaccaactgatctgataaatgctcctaggaaaatagcaagatataaagtcaacacaaaaaggtatgacaacaacttttctatatttgcataatgaacattctgagcataaaactggtcacatttacaggaatgtcaaaacataaccactagaaataaatctcaccaagaaggtaaatgatctcaacaatgaaaaccttaaaacacttccaaaagaattcaaagacacgtggtttgtaaattgttattttgggtattctgagtttctgggctaatattcacttatcagtgagtgcatatcatggatgttcttttatgattgggctatctcactcagaatgatatcctccagatccatccatttgcctaagaatttcataaatgtatcgtttttaatagctgagtagtacattttctgtatccattcctctgttgagggacatttaggttctttccagcttctggctattataaataaggctatgaatatagtggagcatgtgtccttatgacacgttggagcatcttctgggcgctcagtattactgggttctcaggtcctatgtccaattttctgagaaaccaccaaactaatgaaactcaagaacaaagaacaaagtgtggatactttaatccttcttagaagggggaacaaaacacccatgaagggacttacagagacaacatgtggagcagagactgagggaatgaccatacagagtcgcacctgaggatccatcccatatacagccaccaaactcagacactattgtggatgccaacaactgcttgctgacaggagcctgatatagctgtctcctgagaggctctgccagtacctgacaaatacaaaagtggatgctcacagccatccatgggaccgagcacagggtacccaatgaaggagctagagaaaggacccaaagagttgagggggtttgcagccccataggataaacaacaatattaattaaccagtactcccagagctcccagaaactaaaccaccaaccaaagagtacacatggtgggactcatggctccagctgcatatatagcagaggatgtcctagttggacatcaatgggagaagaggcccttggtcctgtgaaggctctatgccccagtgtaggggaatgtcagggccaggaagcaagagtgggtgggttggtgtaaagggggagcaggaaggtgagggggagggtgttttggaggggaaaacaggaaaggggataacacttgaaatgtaaataaagaaaatatccaataaagtcaaagtcaaaaaaaaaaaaaagaaagaaagaaagaaaagaaaagaaacgattaaaaaaaaaaaaaaagacaccggaagacagattggtagagttaataatgtaaacatagctctgcaaattaaagtgattcacattttcaatataatccctattacaattctggaaattgttggaagaattattttaaagtttaaaaacaacactgagtacaaaaacctatgaataaccaaagcaatcctaagcacaaacagcaaagttggtattgtcacagtatgtaacttcaaacatagtatagagccattctgataaaacaacatgatacttaacacaaaacagacacatgaacaaatatactaaattatactaaataaaacaaaacatataatcccatgctgttgtgcccaactatttttttgttttttttttttttacatgagtctcaaaattatacattcaggggaaaacatctttaataaatggtgctaagacaacttaacatatatgtacaagaattaaactagggctgaagagggcttagcagttaagaacattgagggctcttccagaagtaatcggttcaattcccagaacccatgtaacaactcacaaccatctgtaactccatttcccagggttcagatacctctgcaggcttccttgggaagccaggtagccaagtgatacacagatatacatggtcacaaaacactcatacatacaataataaaaaaattaaaaaaggataaactaaattcttctctcttaccctgcataaaaatccactgaaaacagattaaaggctttatttaataaaggctttatttaatgtatgacccaaagaattgaagtggactacatagaagcacttcaagatatagaaaggcaaggactttctgaaagtaggtcagaaaatgttaggaggaatttacaaaataggattagattacattaaaagtttctgcacagcaaaagagacaaagctgtagagattgctcagctgtttcagttacttactcacataagaactaagtttggctccacatggtagcacagttacctctaactccacttccaggcaatctgttgcccccagttctctgcgcacacatggtacacatagcctcataaaggctccagacataaaaaaaaaaacaaaaacaaaaacaaaaataaataaataaacttttaagagtaaagattcagactacacatggaagaaaatctatgctgttttatttttttatatctgagaggggactaataccaagaatatgcaaaatgctataattagattatgctacctgaacacattaagcagttaggaacattgagggctcttccaaagttaatcggttcgattcccagaacaattgtggttaaacattgaaaccacaagtaatatgaattttccataaagaaaaagagatctttactgataaagctcaagtgaccaataaatacatgaataatgatcagtatttttaaccattaaggaaatgcaaatgaaaagactggaaatttatcttatgcccatcagaaaggctacctctaaggaaataaactagactccttgtggagatggctcaggtagtatagtgtttttctttcaagcatgagaacctgagtttgaccaactaaactcaagtacaaagaagccaggcaaggtggcacaagcttgtaatgccactgtggtagaggctgagacaggtaggatctctgggactcactgttcagatagcataatctactattccaggtcagtgagaaactctatcacacaataaacaaaacaaaacaaaacaaaaacaaataagcaaacaggaacaaccatcacaaaacaaaaaacaagtgaatagaaacttaggaaagacttctagcctccatttgcacacacatggaaagcaacaacagaaaacactgaagaggatgggaggaaagaaggaccactatacatagctagtgacaatatgaattagttcagccatactaatcagtctgtatacaggtttctcaaaaaaaaaaaacaaaaacaaaaaacaaaaaaaacaaaaacaaaaaccgaaaattacaactaccatatgatggagtgatgccactcttgggaatgtaattcagtatagagatatgtgaacatccttgtccagtaaggaacaaattaaaatgtagatggtatgaattagttttgatgttcatgaacagattaatagacagctgggattttcttcatccataaagagtaaaatgatcacatttatgaaaaaaattcacaaacacaaagacacacacagactacacatacacacacacacatgaatggcatggaagtagggaaaagtattcaggaaaggcaaagagggtgagttgtaagaaagaagatcaataaaagatcataatgagtgggtgatgaatgtgattaaagtagaacatatactatcatgaaaatgcaatcgagcaactggagagatggctcagtggtttaaagcactcactactcttccagaggtccttagttcaattcgcaactaccacatgatggctcacaaccatctgtaataagattccatgccttcttctgatttgtctgaagacaactacagcatatatatatatgtatatacatatatatatatacatatatatatacgtgtgtgtgtgtgtgtatatatatatatgtatatatatatatatatatatatatatatatatatacatacagagagagagagagagagagagagagagagagagaataaaataaaaggaccaggagtcagaacagatttggggatgtaaacaaacaaatgaataaattaaaggataaataaaatgacataaagcccatcactttgtactagaaatatatgctattaaaacaaaaagaaatgatagcatctagctgcatattacatttctgtagtgaataactatagatggtgtgatttcttaaagtcagccacacattacacattagttgcatccaagatgctaaacatattagaattcgtgtaatttcaacttactgagtttaaactggttagtataaaagtcaaccatttcaatgaaagttactatattttatgtaaataccttttcataattaaaatctattgacacaattatggaaataaaattaaagcacttagcacaagctagcatatacacacactttccacttacatgtgtgataaggttaaacagtgagaacatcttgtctttgatttctgtttggaatgctactggttcttactctaatttattcaacaaatgtacatttatttaaatttccatttcttgtgtgacttttatcagagcaattgatcaaggaatgggtaggttattaagttggacacagaaatgatcattattattttaataaaaaccattgaatacatttaaagttataactacatccttacaaaatttatggatcttttctaagacccaggttttattttacatatttggtttcattgattactgttaataatagtttctttttttgttttttattagataatttctttatctacatttcaaatgttattccctttcctagtttcctctccggaaatccctaacccacccctcctgctccccaacccacccactcccattcccagtcctggcattcccctatagtgggcatagaaccttcacaggacctattgcctctccttccattgatggccaacaacccttgatactttcctactgttgccttctactaaggttgtgattttggtttttcattgtaatgtatggtgttgaaaagaagaaaaaaaatgagtcttgctcatttttatttacatttggtgtgactggatgttcaaaccagtggcactgaggtgtttctggttaaacaatgttggctaggatcatctaatactaattcttattgcttttgtgttgggataagttgtggggggtctcaatgttccctgtcacctccattgatataactatgataggaaatgaaaaaatcagttctcttcttggtaccacttgcaggtgatggaagttcatctggcacaagcctggcaaggaaagtgatatactatttttaccaatacatgtattttcctattccatgctgtcctttcttataaatcataaacatggaggggaaagtgttaccgttgctttgcagacactataaatatatttaatgtcacctaaaatagaaaataacttaggacacaagtagatattattagcagaatatgacatattgtacaagtactagtcagtatagtaagtaatgaaaaaaataacagacttgcaaatttgaaaaggaggaaagacatttattcatagatgacatgtttatctataaaaaactgaaaaccaaaacaagaaccctgagattcaactagaaattggatatctaacctataatcagagcactgaataggcttgtctcttgctaattatctttgagatacatcattctaagaagctacttgtttaactaggttacctgctaaagttttatttaaacaccatcaatgaacaaagactctttattctttttatcagtgacatcacttaagtacagacaatataatacttaataaagtaccaaatgcagagctcaattttggcctgttaggttaagtttatagataaacatataatactagtagaatgattatatatgtcttctaggaaatccttacctactgtttcccaaaattaagaaaatcataccatatcacaagattagacagttgacaagaaaaacatattcttatcaagaatattgtttatgagtgcttatttacttggacaaaaggtatagtaaatggcttctcatatgaaaattgaattggctatacaatacaaacataaaaatggtacttttctttttgaataagttagactgattttcactcaacctgtctaacttgagaacatttgacttactggcaaggggttccaaacgttagacaagatggcacaactttgttatctacaacattctcagttaagaactgtaacagagagagagaggagagagagagagagagagagagagagagagagagagagagagagagagagagagagagagagagagggagagagagggagggagggagggagggagggagagagagagagggagagagagagggagggagggagggagggagggagggagggagggagggagggagggagggagggagggagggagggagaaacacatcctaaaatctcatcatttaagtaaatttacaattttgtgttatgttgtatttatagcttttcttgcttcatgaagtcttcttaagcctacaagccacagtttgactatacctgaatagtttaaacctagtgttgccttgatggctttctatcctgataacctgtgcactctaaagtagtgtataaagatctaaggctttactgaaccttagatatctcacttctcatcgtttaataattgctttctacatttacacacaccaatattgggtggatatatttataattgttataaggtaacttctgtaatccattttaaacttccactattgtctccttgcctcccctttgaatttacagttcacattttaaagaatttcaaaacaccccttatttttcattgtatttattaggatagctttggccaggtcagggacatacatctttatttatagcacttgggatttaaaagaagaagttcagataaaccatgaatacataatgaaaccatgtcacaaaaaaaggaaaacattttccttgatgatattcacactaaagattgtcactaagcctcttactttattatttaaatttgggggtgttgagaatgaaatacaaagccttacatattctacacaagcagcctacctctgaactttgcatttggttctgtttccactgtaattaacaattttttgtaggactggagagcaaacctaggatttaatgcatccaaggtaagcactctactgctgtgccaaagaccctaccaatttaacattttacataaggcaggccacttttatcacattaacttttaggggaagagggagtggtctgttaagtctcatgtttctgaaggatagctctgttaagcatagtaattcttggttggcagcactacaaccatgtaataacataaatattaattcatttatggatgactgggacatagaagctctgacatattagtcaattaagcctaattgttggattaatctgaaggcattattgaaaaatggtagacagaacaataggtcaccaggttgttgtctgtagccatgtcttagacttttcatgtctcttcctggttcttgaccactatgaggtgaacagtcttgcttcatttatcatatcttctgccatgatgtcctgcacttgtaatcaacaaaagcaatggaagcagtagatcatggactaaaaccaccaataccatgagtcataacaactgtttcctctttttaaattgttcaagtattcatcaaagtagacagcagatgcaatttttttctttcatttctaaagttttctttttttttattagatattttacatttcaaatgctatcccgaaagttccctataccctcctcccaacctgctccccgatccacccactcccacttcttggccctggcattcccctgtactggggcatataaagtttgcaataccaaggggcctctcttcccagtgatggtcaactaggccatcttctgatacatatgcagctagagacacgagctctggttagttcatattgttgttccacctatagggttgcagagcccttcagctccttgggtgctgtctctaaaaattcaggtgacaacagatgctggtgaagatgtggagaaagaagaacactcctccattactggggggattgcaagcttgtacaaccactctggaagtaagtctggcgattcctcagaaaattggacatagtactaccagaagatccagcaatacctctcctgggcatacatatatccagatgcaattctttagccctttaaaaacttctctacttcaaagcatgatgtttctattgaggtgtatgctacatatacgagagggctcttatatatggtttcttttgttttcaacatttttctggtgtgtgtgtgtgtgtgtgtgtgtgtgtgtgtgtgtgtatgtgtgtgcgcgtgcatgcgcagaggcgcacatgtatacctatgtgtgtggcacaaggcaatgactatgttctggggcaaatacatagaccaaacctggaatcccgtgaactacctgtacctgggtaactttcacctagtataggatgtttaatgccattaattcttcagcctcttaaacctttctctttgttttatcttgaacacaaactatttgaacctttgtcctattgtaacattttgtgctattgattcaagccagggaattgggtaagcaaagcaaatgagccaacaccaagttaaaaaaaaaattcctttttaatcgtgctccaccaatgccacaaacttccttcattcattctttatttttctcttctttctatatattttcagataactaataatctaggtaagagtttttatttttgaccaatgtgttatttaattgatgttttcaggtctaatatttgttgctattgttccaatcttttaaccttccagtcatgtgttatttgttttgaatcctcaatcattatgtttgaatatcagttaaatttgcagtttggtaatctgatacatatttttattacattcgcctaattgctcagatacttcacacatttccagtttttccttattaactatttgttctttccccctatattataatgattttgagcactcttttgacccttgtaataatgacttagtgtgtactaaagtagatactcattccaagttttttcagtcttcctttggaaaatgcctgttcaaagaccctggacagagtgccacaacctttgagcccatgaccaacacagcctttgaaacactagggaattctctcactccaactctacactggctagcacaatgctggactagaatcctgtggctattgatacaggcagagatttgagaagcactcaaaacctagaggtactgatgctaaaacagcactaaaatatgcccaagttccattgccaccaagccccttgtagtcatccagtagtgtgtaagagaacacagaccaattccatctggcagttgctacatattcttatgtgatatgagtaaactgttgcagctcaaatcacaggagggtcttgcttcagaggtcatactattctgatcaataaaggtttttatgtcatgcctagttggtattggggtccatagtaaaacttacatgcttatttatccaattcattcactagctatcaaactgcatacatatacagttttgcttataaattagttggtggatattttgtatgtctttacatggtgactattttcaagagtgtggcttttaaaagttggtagaaagactgctggagaaatggctcagtggttaagagtgccaaccgttctgcgctggagagatggatcagtggttaagagcactgactgcccttccagaggttctgagttcaattctcagcaaccacatggtggctcataaccatctgtaataggatccagtgccctcttctggtatgtctggagacaactacaataaatacaccttttttaaaaagcacaaaaagaatttttaaaaaaatgtggaaagcttttgtttgaatacttcagttcatttggtgatatacttgctaggcaaataatcaagtcataccgattctctttagtttactgaggaaccaccaacttcttctttccatatcagcatgattttacactcatattagtcataaacattctatatttttccatacttaccaatatatttcatctttgaagagaaaggccatttagtgggcataataaagcatctgattttggatgtaatttgcactcaactaaggaatagtaaaggagagcatcctttcaagttcatgccactaagtatatgtatgctttagcatctaaccgtttagaagtttttgcttggttcattgttggactcgactgtttttgctgcagaattaccatgtgacacagctattccatacactggatctttatcagatgcctatgatttggttgaaccaaaaacctacttgctcttttagtctttatcttatacctgaaagttaattttaaaattgaagattacaaacattttgtgaagattgaggatattcataatacttaaaccttttgttcatttttagaaaaaatggtgatctatacttactcttttttaagtgaaaatacaattttatataaatacttttgtttatttactgtttggcatacaataaaaacattaaaatcatcgagcctggagatcagtttaattttaatattatatacaacaattctagctctgatcccacataccaatacataattatactcatatattatgcacacaacttatctataattgctacaagttttcttgaatcaatgaaaaacggtgaaaccccacgtacaggcagattattacctaatgacctttcctgttatttctatttattcgaactattgtctactgacttttgtttcagcttgacatactctacctgttataattacagaaaacgttttaagtggaaacagtagattctcaaactcatatcaaaatagtgggcttggttatcagtaatttgacacaaagtgaatgtttccttcttggagttatttaagctctttgttgaggtagggttttcatgtagccttggctggccataaacatatgtattcaaaaaagtccttgaacttcaatttttttctttcagttttgttaatggttacattatattcttttggagctttgatatttacagctttgtaaatactgttatgttgccttagtcagttgactaatccccacataatattccttgtttcctctaagtactaatttttaaagtctctacccctttcccaaacctgatatatatcttgctctctgccctaattcactttgtgttacatttgcatggaagggccctttttctcaatcttttactgccaacctgtttttttgtttttgttttcctggttacttctgctcttttaatttattgctcgtatatgtaaatgatcactgacaaatgtttgctttatatagtttggtccttgtgtgtctcttttttttcttttttttctttttttaatcttttactgtttggcttgcgatttcctccaatacagccattaatactcatctcttttttgggggacggagggtaatgtcacattttggctcgttgtttgcttttgtgtgtgttcttcagtattctttgtagaaaccatagggcattatatacattcttcctaatataaaaacaattttcattgaagtactgcataagggacaaatctaaacattgtataatttaaatttaagcatttaggaaatagtaattcaagttccaacacttgttttctaataccttttctttgctttgacattctaagagtgacaaaaaaagtataccttgtaactattcaaaatgatcaatgaaaggaagaaaacagttaagttgtaggcctaggaacatacagtaattaaccataatgaacaaagtacagatgaaatagatgaataagctaagtacagtagattcagtacttaggatcactgatgttttatatccagagaaccctacagtaatcatatccttctaaataatttttcacatggcttctatatgatacgatgatgcaaaaacatttgagctataaaggacttggaatcctttcagttttaattattgattctcacatctaaacttaaatttgaactgacagattaattgcaagaggcttcatagtggactactttatttcaaagtaccacaaattacacctttataaaatgtacatataacatgacttttgttaatttctaaaattcttcagaaatactgggtttaccaaccaaactgaatactgaggttgtttaatcttaaaccataacctgagtcgaaattgttccttccacattaatcttattctaattatttatttaaagcaggatcttactaagtagccctggccggccttaaacacaagagatcctcctgtttctgcttcccagtgctgagactaaagtcatgaactaacgctatctgtattctcttaaaaaaaaaaaaaaaagacctagtagtagtgatttctcaaaacttttacttaagaattcctcttaatattgctctcattctttttagaaacttccctggatataaaacctcagtgttagtgttctcatcctatacctccacccttcactctttctgcttctgtaccctcctttcagttcctcctcttaactttggacatcgaaaaaacaagctatccaatcatttaattggagacacatggatattagttgcttctttttgttgctttcaagattctgtctctggattttggtaagtctgattagaatggatcatgataattaccttttatggtttactctagactatactggatatcatatgcatgtacatttgtgcctcaaaaaaaaattgcactttttccagctattactccttgaacgttcactcttagggaaaatttggtgcaaatacaattagaataataaaatcatttaaaatgggaattttgctttctacagctctgtaaaggttatttttctgatagctccatagcatacaattgtctcaaaactattgttctaagggtcttgtacatcctaacgaagtgctttatcaatgaactataccaatgaattaaatcaattataccaatgaattaaatcaacaacccggataaccctacaatgacttgttttagggttcagattgtggtatgttatgacaaatgcttaaaacacatttttttttttaaattgtcatttcactgttgtgtgagatgctccatgtcacttacagtagttatccatggtgtccaagtaattatgggtttattgttgtcctactaatgactcaaagaggttattttaagatttgcaacttatgcaatgtagatatgtcgtttttcttgtagtcctgttatgaaaggttctagattcttccagtaatctaggactgctcttaagtatatagagaggtctgtcacctgttttcctaattttttagttagctgcatgtttgtctcaaagcgtatttgctattaacatgctcaacttttttgagaaaacactaagatttgtttccatcctttaaaaaatcatttttgatatgcatttaatatgtatttaatatgtcttatacattgaatagttaggcctttatacaaatccaactaaaattttctttgcaatgtagagtttatattataaagttttatcactttgttattctgttcattagcaccactatatattttcccgttgtttctgcttttatttaaattgagcattgtattagttccctaaggttgctgtattactgcaaactaagtgactaaatgacatagtgcaaaacaattcattgtgttaattctggagattaggcatggtaacattcaaacaaacaaacaaaagtattatcagggctttacctaaaacctgtatgagaatcactgtctcttccaggttctgatttttttcactttttaaaagtaatctttggtattcttcatcttgtagaaacaatgcccaatctcttgctccatattactcattttcttcctatttgtgtttgctctccttatatagtaaggacatcaggcaatactaaattacagcttattctaaagccacaagtctcaattaaatacaactggatagatacttccaattaagtacctcttcacaactgtcagatatggcaatctaaaatctatatgtatagtttaccaaacttaaaacttctggtaatcttcaaaattatttgtctctgactttcttcctgttaaggagctttgatttacacatgctacagaagaaagggccaagttgttgcttcgcttgttaccattatggtagctagaagttagcctttgccaacattccctgtaaaataggaacctgaggttaattgtcataagtacctaagagaaatacctgatcaacgtccaaattatatcttcatactctgacagctgagctgagtttaaaaaattatagtaccagtgtcttaccgggttgacaaaatgtttttaggcatttgttgagttttagatatgagactctcaaatttgagtggttatatattttcataagttctatcaaagctaattataacacaatttcaaagagttacaagaagctattgactcactagaaatcctgccagcattctgctcaccttcgttaggtatccctttccaggctcacctccattcctctctataccataaaacacagaaaggacaaagctcagattgcaataagacaaatgaattgccttctccattggctttttcatttccccttctgattttctaggacaatacatttattaatagttaaaagacaaggccagtgacatggtttagcatggaagtggacttgctgctatacctcacaatgtgtatttaaccccattagtcacacaatagagaaccaactcttgcaaaatagtctacatatgaaattccattaagaatgatatttgatatactacaagtggcagaaattttcggggatacactaataaaaagtgacaggagcacactgctagttttgtagagagcttgggacagtctgagatacagaagaggaatgggggaaagagtagggttctgggtaaattacacatggcgactatcagtggatcccacaaatgcgcactcgcacgtgcgtgcacacacatagtaacaattttaatgaacaaagtataaaatgctagtcctccactagaaatgactagtattgtatacaaggatatcttcccaattttttttttttttttgccataacagacatgtaactgaaatattaccttttatgacagaaagaaaaaaaaagagggaaaggaaaggggaaaggaaaggggaaaggggaaagaggaaaggggaaagaggaaaagggaaaggggaaaggggaaagagggaaggggaaagaggaaaggaaaaagcaaaggaaaagcaaaggaaaagcaaaggaaaagcaaaggaaaaaggaaaggaaaggaaaggaaaggaaaggaaaggaaaggaaaggaaaggaaaggaaaggaaaaaggaaaggaaaggaaaaaggaaaaaggaaaaaggaaaggaaaggaaaaagaaaaggagaggaaaggagaggaaaaaggaaaggaaaggaaaaaggaaaggagaggaaaagagaggaaaggagaggaaaggaaaaaggaaaggagaggaaaggagaggaaagtaaaaaggaaaggagaggaaaggaaaaaggaaaggagaggaaaggaaaaaggaaaggagaggaaaggaaaaaggaaagtaaaaaggaaaggagaggaaaggagaggaaaggagaggaaaggagaggaaagagggaagagggaagagggaagaggaaagaggaaagaggaaagaggaaagaggaaagaaagaggaaaggaaaggaaaggaaaggaaaggaaaggaaaggaaaggaaaggaaaggaaaggaaaagaaaactgagttcataccactaagctcatcactaaagaactggaagtttaaagtgttactagataactaaagagtcagcaaactacaggtttatgtcccctacaagtgctgttatatgtgacatacatgacaatttcagattgttcccattttattatttcctcttatgagttggttatgtagaaacagaaaaagcaaaaatggtagagatgaaaagcaaaaaacaaacaaacaaacaaacaaaaaccctaaaaccttacataaataatggtttacacatgcaaactaaagaacttggaagaataagttaaaagttgcatagtactgaacagatggtttaaagttacatataaaaacatgatggatttacccactatcatctaaggaatgagaaacaagctggttttccttctgttgctttcccatacaggtgtgcccctaaaaccagtagaggatttcgttttccctccacagtaggaaagtgtaaggagtatctgaatcggtagtaaagctgcatccaggatgagtcttcatacacacgaacaatctttgtaatgattttttttcttagctttttattgggtacttttgtagaaatttgcatgtatggtctggttggctacccaggatctttatctttgcaatcatttcatctatacattctttcgacagatgtattacagcctgggaattgaggattaaaaagaaaaaagtgaaagaaaagttgaaaccactcctactctaggacattatcaatgagaaattgaggcaataactaaagcacatacacaaatatatatataaatacagatgacctatatgaactatatctattcagagaaacacagcataaagatatattggtcccaaacactgtatttggtgttcttggtgggagtaggtaaaagatgcaagagttttggaaacatcttctaaaatacagttgcataataggctaacttctactactcaaaatgtacatcatctagttagaaactagaaccctctgcacaattttatcttgatctacttccatccatagctagctatgtctgtgtcaagaaacctttttcatttgaatcaacaaataaattggaggggatagggatgtagctcaaaaaagcacttgtctagtttatatgaggacctgtgctcttctctcacaagtctcctacccaaaataaaccaacttactactaagctctttcagatccactgagaaggatcaaacaactctattgaggcagagtaatggtaaattattttaagagttaatatttcaattatttgaaatattttgatttggctaactagatttcataaggtacatgtatatctggttatttaaaagctatgataattgatgataattgagactggaatggaaggcatttagctagtcatatgggagattgtaaggagaagaatggaaatgagactctaagacagtctgctcattgtatggttccaaaaagtatcttcatattttgatgtggatccgtaagtcacagttacaaattccctaaccttgcaaagcttggtatactgagtagaacacagggtcaaacaaaccaattcctttttgtcatttctctttaacatgaattctttgtatacctctcaaaggatagtaattccatagattctgtcctttgtcgtctcttttcatttcatcacagttccctgaaagtattctaggaaaatactaacgatgactgtcatgctagagccactcattttcatcttggtgaagatcctctctagacttacccttgaataatctcactacacaaagaatgtgacttagtacactgcaactcccctgcctcatctgtcccagggaaaacccaatggcatcattatccctccatcatccatatcaaatatgtgaaatcgttcacttgactctcctctatcccatacactatcccttctcttttatcatgctgaatctttctgcaactatagcaacaatctcattaatgcaaagaatagagacacttaggctttcccagttcatatggtaataaatgtataaatttatgtctttgcctcttaagatatgcaaagtaaaatctgaagtctacaagacccatcatgatctgtctggctgcccaatcacatccagctacttatctcaacccaatacggcccctgttaaaataaaatgctcttcttttctgcctggtaaccatctaatcctttaccacgtgtcatagtttttggatctgaattctcagtctgctttgttgcatgatgcagattttatgcatgtgtagtacaggtggggtgtagaacaagtcgttcattttaaacacgatctctggatttttctagcagtgagacctcaagctttgagatttttctgttcataaacttttttttaattttacaaatactaaacagcatagagctgacagcagtgaaacattaaaatgaccaactcttaattgaagacgaaagtcttcctcctgctcaggtcctcctaccgcaactcaaaagaccctccctactcattttaacaggtactgagggaacttctgcactataggaacttattacaaagatattgtcttacttatcaagttcttaggattaatgcaagtggtagtgaggattggtgtattaataactttatttcagaatttaccttcttggcaatcccaacttgcttggctgttagtttccaatgcctcctacgctgtaagcgtctttattggatgacactcagcttccaattgtatggcttactaaggaaggaaacttctatagggcaattttcaaaacagctgatggctaatactttataataatgatatatgtatggctcatgagaagcacctacctgaactcaagactggtgttaactgcattttattctactgtcaaatggcactttagacatgtcttaccttggaatcctttcaagagtcaattacctctcccatgtcatccagaatctaaagaccacagaataactttcaaagtatattatttcaaacacacctcactggatttaagaacagttggaaagctccaggcatatttggagaccagtatcagtaataccctgataacaaccagacaaagataacaagaaaactacaggccagtatcttttatgaatacaggtgcaaatatgctaaacaaaatactagcaaaccaaatccagcagcatagaaaatggtttatgtagcatagacaagtggggtaattccaggaatgcaaggttctttcaatacaaaattccatcaatgtaatacaacatatcaatagaataaaggacaaaactacatgacaaccttattagatacagaagaagcatttgacaaaattcaaaacccttttcttgatttaaaaaaagactcagtaaggtaggaatagatggaatatttctcaacttgcaacatctatgaaaatcccacagctaacatcatatttaatggtgaaagacctaatgcttttccactacaatcagaaacaagaaaaagatgtacactcttgccacttcaatttaatatcatattggacgtgctagccagggcacttaggcagggaaatcaaataaaaagaatccagattggagaggaaacaaaagtatttatattcagagatgcacaatcttgtataaaaaattaaaaacagaatcagctcagaatagctacagtatataaggttaatacataaaaatgaattctttctagatgtagcaatgagtaatccaaacaaatattaaaaaaaaagttgtttgtaaaaggatcaagtgaaaaacatttaactcaaaaaagccaagatgtatacactgaaatctataaaatagcattgaaagaaattacacacctaaataaatggaaagacactccatatttatggattataaaatttaatactgttaaaataccaacatacgtcaatctgatgtatcgattcaacacaagaacaatcaaaatcacaggtgctttttatgtagaaattaacaaatagattctaaaatccatgtggaatgcaagggacccagaacaggtaaaattatcttgatgtagaacaaagctagagaactaacacatcctaaattcaaaacttactctagggctacagtaattaagacagtatggtactggcataggaagagacacacataggacaatgggacaaagttcaagaatccaaaattagccatatttatggtcatttgtacgtgtttttgacaaagatagcaagcctactcataaggaaattactaatagtctttgtaacaattaggtattgttctactagatatccacatattagagaatgaaactggatccctaaaatgtaccacatgcaaaaatgaatcaaagacctaaatttaagaaccaaaaccataagatacttaaaagacagtaggagaaatgaaaacatgtacacaaagtgttcatagttgtattcataatatgcaaaaagcagaaagaacacatgtatgcacaaccaagtggacaagcaaaaaaatacagcatatcaatacaatgacaatattcagccacaaaagaaacagtaccagtacatgctacaacattgatgcagtttgaactcattgctttgtggaaggtggcgaaacagacaaaaaggccacataattgtatgactccattaacatgaaatgaccaaaataggcaaattcataggcatacgaagacgagtagttgccaggggttggagttaagaacaggcagtcactcttaatgggtacagaaaactttttacagcgatgaaatgctctggaattttataaagacaatttcacaactctgtgaatatactataaccacaaattttacactttttaaaatggcgaatttttatactatgtgaattatatctaaaagatgtgagaaaacacatctcttccatttaaaggtggacgatataaggtcaggttttagaaaataagtcttcattacagacatttctaatctctctctctctttttttaagttaacaagcaacgttgggagaactgttctcaggatgtcttccaagatgttatctaccagctgcatggtaatttcactgaaaccacacaaccagagataaggtaggagtgggtataatccaagtcaagggaatggcagtgccaaactaaaattcagagtcatttgactgaaggctacaaccccaaccagtgtgtactatattccagatacattccttatcattttctatgtgtttctgggtaatgaaaaatcataataatgatccaaggttccatgcatgtcagcataataatcttaatttgttgtttaatttagtcatgtttgtttttgcaaaaaggaagatgacaaattttaggtggtcatgtggacgcaaccttaccatttgtcatcccttttcctgcctgtatgacttttagtaaggtgtataacctctcaagttacagatatttattggctttgtgaaaatgaaggaccatgtgcacagatctttagcagtcattgaaaattcttgtcagaatttacaggaatttgagcagcaaagtataagaaaatgttaaatatgactcacatatatttacagagaacagcatctggaggattcctctatgaaaatttgagagactagtcagtaataacagaacgaattaaggtatcagttgccatgactgctggaagagtatgagtggcataaagacggtggtcaagagtacaccagaagacaggatgtagagttacaaaactgtcttgctttcaaccatctagtcttttccaacttactgtcttttttaccctggggcagatataatacagtgattccagaaactctattcaataaatgtatgtgtatatttcttgattaatgcttatctgcctactgcctaagagacagaaagatcagtacaaggtagtttccactgtgaatttactcagattccatacaaaagagaagatgctttaaaaaaaataataataatagtgggacaatatcaaagctaaaacacaggaaagaaggaagggaacgcacttctgaaggcctcctcaactgttcaaataaatatgatccaccaggctgtgaccagggatatgtaggctgctattacactatgaaggcacactgtaactaatagaagtctttatgagtatgatactttcaaaattccaactgaaagaatatgtgagttgtataaagttaatctaaaaaggaattttgagtagtgatgaaagggatgctgaacaggatgcactagtaaattatgcagaaatccacctgtacaaactattcaaaggggaagtactcatacaaatcagaaaaaaaaatgctttttgagaatgaaaagaattagaagtagttcagagtcaggaagataacctgagtaaatcaaaggattggggcctgaaataaagtacaattaaataggtctgagagacaataactgacaacatgcatatatatgcacataaactgtgagagggtaggaaacagcaaaagctatggtaaacatggaaaggccaggaaacaactttgtggagttgctctttccttccatgtttatgtggagtctaggcagagtcttcaggtcaagttttatatagtgagcacctttacccactaagccatctccccaggccaaaaaattgacagttctaaaggaagtaacaagaaataactaggagatacaagagtaagaattttgtttttatcggtactgttttgtactatataatgacttagaggtaccaggatgatgtcctggaaacacgggtctgatatgatatgagatatgagacccacaaaatatgaggcaagagaaaaaactttgggttgaacaggaagttcagaggagtacttctaagtacaatcaggagagtatccatacaaggtgtctatgagttgggatggaaaagtgagcctttcaggaagctgtagcccaactctgcaaggctctcaagggttaaaaacaagacttctttactgtggcaaatggagactactagtattattgcaagtacattttcagtgaaatattcctggattagcagcctttacatagtgaaatgcagtacatacatgcactcaaatattcttacaactgttaccaaagtcaattttcttatttgaaagtagaagaggggaaaaaaaaagggcctctgtctatattgtgtaaacatttttcctaccaaacaccaggaactgttttacactctaaagatgaaagaagcagcaaatggaagttactattattattattattattattattttattctgggaagggtagaaaggattaaaatagaccctgggataagcagttaaagaatgaacatcttaaagagtagcctcagtaaaacacttctttctctagggtatgtggattcttgagaaaaaaattctttaaaagaggttgatttcagcaatagccaccttatggaaacacggagtaatgctgcctagttgatgcatttgccacatgttaatgtgaacaagttctctgaaggctcatttataggtttcttttgatatatacattcctacacaggatgtatttccaaataaaggtaaggttattgcaaatgaatttgatcacacaattaactatagaccacgatatgtacactcaatttgtttgctgcagctgccaagtttccagagaagttttgctgcaggctgtgcttttatgccataagtttgaaatgttctacactactaaaaggtattttttaactcgtaagtattgttccatgacaatctagtaaagcaatcatgaaaaggcagccatattaatgtggtaacatgccgagaaaaactgattaggaagcaagtgagagtttttttttttacctctgaaaactttttaggatttttttttcactttcttttaaatatattgatgttacttctgtttgataatctatattatcatttgaaaactttcacacagatatagtatcacaactacttcaatactgtagtgacaataaactgaagaacacaaatctcttcatgaatttattttataaaatatacccacttaatttgtcttcttatcactttcataatacataagaagcacagtggacaagatgcccattaagatgactatagtcacatttagggggtcctataatcaaggtagcatacataccacaacagtgttctaaaggctagctcagaaaaaaaaaaaagaaaacaaaacaaaacaaaaaaacctcacgttaccttatcacaatatggaacgcactgtgttctcttttcccattaaaatatttaagccactgtttcatttagcattacagtaaataagagctctgtctcaactactacaagaaagaaaataatcctaagacatccttttccccttccaatgatttgaaagctaccattatcccctgccaattaaaatcatcaggttgatttgcactagttgttaaaacaatcaaggcacaagctcaacaggttatctgtagcttgtagtaaaatgatataccagtatgtctctccttagttaaaaatacataattcttttattttgttatgcaacaaaagaaattaacatcacagacatagaagactagggatgggaaactacattaaatatccagtaatttaagcctatttgtactttaatataggacatgaaatctttaacacctttgaagtaaattttaatttgggggatatacaatttatttctcaggagtactagttccattcatttccaggcctgctaactgtgtaaataagtaacacaaggcacagtagctgtactttctgttatgctgcaacactgatcgagtgccttgaaaaatggttgattaaacaagatgacggcaacagaaggggagactttggattgtctattaaaatctcagcaataataaagattcattttaagtgcacttttacatgcttatttatacaacaaacttcctaattttgttgcaataggcttgactatcctatcatttggccagatgcactttccccagtaaacttaaacaacaaaaacaacaacaacaacaaaaacaacaacaacaacaacaacaacaaaaacaaaaaaaaaatccctgtcctttcatatactaagaggattggctactgaaacagttcattgcaagacacatgaagacaacatactgtggcatgagttgttttaatttgttgtgctgttactaaagttctgagggctgtggttcaaacattccaagttctcccttccatctttattggttctcaaaattttgtacagaaaactctttgggggctagaacagcagtacttgcaccacactgtttccttgacttcaagtttcaaaagcaaattgttagaaaaaagttcctgatttgacttagatacagggacaaaaaatagcacatacttgaagattacatgttctacaaatggtggcaatgttttccttgcgagaatagtttcgttggtatatatatcttaaatactcaaaaaggctcaacctcaagcagtaataaacacaagcaaaagtgatttaacccttaaaataaatattcagaaaacctctctgtacatacaagtgaaagaatatgtaacactttcacgcaaaaaaataattataataataataaaggatttgttcatatatgcagctgaaatctgctgttccagcccacaatgtccccaatgaagaagggaggcacagacatagatgactactgtggttcactatcttacagcctttttgtactgggatactattaccatcaaattatccctcttatatttattttttaactttttctttttctttttctttttctttttgtttacagcatgccaaatcctttggcatatgtgatggccttcaacaatctctctttaagtttttctttgcttgaatattccggaagtaaaaggacattaaagcaagtatgagatgtaggtaacctaaataaagagaaagggaaaaacaggacaatcatgagtcattggaaatatgctcagtgttaaatgctcctattagatacatatcttgttaggacggtttttaatgagaaactacagattaaatatatcataaacattgtactgtttagttaaaaagatcagttgggtctttatcctatgaaataatgcaaaaattaaagtgatgctgatgatagtaacatttattatctattgagtttccactctgttacctattgctttagatactttaacactgaagttcatttaaatctttacacaacaaacatcttactaaacccattaaaagctgaagtcactaaacaacttacaccaaagattaaaaattattcaaacctggcttttaaagattttgaagtctatgctctgtatatagatttgaaatactgctggcaaaatgaaaatgataatgattgattataaattaattaaaattagagccaagatgtataaaatgtctaattaacagtaataaaaatatatctgtcgatgtatatcgaagtctacctaggacatattgttcagccccaccataaaattgtgaagtatttattggagaaagaatacaatcaaaagtcagaatgatttaaccctagaataagaatctagtataatgtaaaagaacagacaatcctctaaattttagtgtagccattcaaagtagactgttctataataaggctttcttaataaactatgaaacaaagggggaataaaacataacaacttgataacgtctgtacttctgtaagctccataattactttttaactacactaatttttaaaaaaattcctcaaatcatgaagggaaaatatccattccactagtgtttgctgacttagatatttcaatataacatcagaagagtatatagaggctacatgttggctctgcttgcgtgtatggaatatggtgaaaaggtttacagtgggtacaaagttggagtttgatattacctttctgtgtctgggccatttttggctataatcatcttcaattttcctagtcctccaacaggtgctctgtctgtgcctgttgtaaactgcagaaagagtcttttctgttcatctgtaaacgaatgaacaatttcccagaactccctaatgtgaaaagagaatactggttttaatttgacatccactataaacaagatcatagtactacaacattaaggccaatgtcacagtgaatattaaaagtaccatttacacttagtatgtaagttttagtcagccagattttatatcttgtaggaactatatatgggataaatattaataactcttttgctcagtaattctacttaaaaagtacttttgtattcctaatgctaagcgtgatgttttaaaatttacttttgtaaaaaatacatgttcaatatcctattcacatttctaaaacctcaatctaaaaatctatcaagatcttctccaaagcaagagaaatgtgcaataaatatatctgtaatctatgctgagaataaaattggaaaatcaagtaataaatccccaaagtaaaagtagagagaaataatacacaagataagcacagttaaggatcagaataggacaaaaaaattgtagacactggaagagcggaagaaagaagtgacgaaactttccaaagatgatagaaatacctggtgaagggattttaatttttaaaaaattgtaagtgaaaagtagaaggcattgaatcacataaagcagaaccaaatattaaagaaacagcagtaaaaggttttccttcattgagaaaccacttaaagtgactgtactatgctttgctaccccatgacatttactaagagcaggtccatgggaggaaatatataaaaaagtaaatgataaaaaataaatttaagtccaataggaatattatgaagagttcttcaaatgagaaataaggctttttggaatatgaaactatttttaaaaaagactgagtcgtgaataatataaactctaacatgaaaagtttaacgatggcatcatgaatcaaaaataaagagattaatgaattcaaacagaaataataacacttgaaaatactgaggcaggttggtgagatggctcagcaggtaggagcacagactgctcttctgaaggtcctgagttcaaagtcccagcaacctcatggtggctcacaaccatccgtaatgagatgatccctcttctggcgagtctgaagacagctacagtgtacttatgtattataataaataaatcttttgggccagagtaagcagagtgaccggagcgagcagaggtcctaaaacttcaattcccaacaaccatgcgaaggctcacaaccatctgttcagctacagtgtacccatatacataaaataaataaataattcttaaaaagaaaaaagaaaattctgaggcaaatgcacatcaactctagaaataaaagatgattcaaaaatgaggtaagtaaatgagggaagtgtagtaatttgtatttgacaaacatccaacatttctacttgacaacagtctagaaacaaaaagcaagcaaagggttaggaagtcagaaggggaaaggagttaaaacaaaatattcaaaactgaagaaatgcatatcaaagtaaaatggaaacaaattgttaattgactaaaacctttcacttggtaaaaaaccctaacaagtaaagataaatgacattaatgtagagaaaatactgtaaattactccagagacaaatgtctctcatgtacaagaaaaggcaaagggaaaggaaatctaaaaagtattcctatgattcagcattttgaaggttgaggcaaaaggtaggcaagttctaggctaggctatgctacaagcaagctattgttcaaaagaagggtgtgagggggatcaataactgaacaataaaatgagtaagagacaatattaaaaatatgattaggtaatataatgaccttgaaaatagaaaactatacttcaatattatgtgacagctggaagagagcaaaaaagttgcaaagtaacctctatgttaataagggattattttgataatatacttaaaagattctttctaggtttgttccttgacaaggccttaccagtcataacattaaatagtaagtcttattcctggatgcagttttctaataatttcttttaacaatgttttcttacagggtaggggataatgttcaagataaggcaaaatttcaaattttaacaaagtcatgtgtcatgttaaagatacaccaacaccaagcaaagtcctaagcaaggctaaagtcctaatggtaaaacacatttactacattaaaagtaaattcatgagttcataatatctgaaaacaaaaaaattaccatattatctcttcagtatcaatcttaaatatatttgactttgtcttttcaatagattgatatcttaaggtaacaatataatagttgatatgaaaaagataggaaaataggagaatgacatatgtcagatgactagataaaattatttccttaaatcaccatttttataatcacaggtgaaatcatcaattaaggaaagacaaaaaagatatacaaggcaaaggactattgatcacagcaattttgttactgctccacaatctctgtaaacagagcaaatttagataggaaaatgagaggtcaacaattatgttttgtttattttagtcttctgaaaaggagacagaattatttctctttttaaaaaaatgaggagggagttagaggaacataaatcagcaagcagtgctgcaatggatcctgctccaagtttccttaatgatggatggattatgaactggatgggtataaaaatgtacaaagccgggctggagagatggctcagcgattaagagcactgactacacttccaaaggtcctgagttcaaatcccacaaatcacacaaccatgagccaccatgtaaaggaatgtgatgccctcttctgatgtgtctgaagagaacataaaaatgtacaaagcctcaaatgacatagagaaagtatgaatatttcacaaaagaaatgtttctcctcataataagcaagagactcttctaagaacaaaaagattcagtcttgaaggtgactaaaatggagaaagaaaatcagaaaaaaactcaaaagaaccgaggaggaatgaccatgtagaaatgagcagaatgtgcttttacaaaaaaaaaaaaaaaaaaaaaagaaagaaagaaaagaaaattggacctgagcaaattaagaatataatacacgagccaggcgtggtggtgcacgcctttaatcccagcacttgggaggcagatgcaggcagatttctgagttcgaggccagcctggtctacccagcacagccagggatacacagagaaaccctgtcttgaaaagcaacaaacaaacaaacaaacaaaagaatataatacacggactgaagaaccattgcaacaaggacaggaatattgactcaaggttaagaagaaacatgacatttaaagcaatgtgtacttttaaagaagctagggaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacattggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcgttatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcacctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgacaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactgtctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaccagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatctagccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtactgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccaaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtaaagcattggaaatgtaaatgagctaaatacctaataaaaaatggaaaaaaaaaaaaaataaagaagctaggacaaaaactaagacaaaaaatagtaaaaaagaaagaaaatgaaaacctttgaattgaacagagaatatgaagaattaatcacattaaataatggtgattttattcacactgataattaaaaaaattttttgaaagaaaaaaaaaacaacagttcgttgaaaaagaaatgcaaaaaagaacagcaaaaaggacagctaatagaccttgaaacaaaaacaaaaaacaaacaaaacaaaaacaaaaaaaaaagcggaaaactttcatatagcaatggttccagagcatgccaggaaaagaaaaattaggctccatttactgataaaagtgaacatgaaaacctatttgaatgaatagttaaaaaggggatatggcacaaagaactgaagaacaagagttatttccaataaacttaacttgaactaaaaaagaactgaagtagcactacaaaagatgaggagaaagaagggcagtagcattatgaattactaccctatgaaagatgaagagcaaaccaaaccaggagctaagtagttcaacaagccattataaaaatatccaccaactattcaagtgccccacttagatttaaagtaacaggagatttgaagcccgaaattacaaggtgattggtgggagaaataatgcggggaggagaatttggaggagattgaaagaagcttattggaatttaccagaaaatggaggaaggtgtgtgtgtgtaaaccaaacaaaaacaaatgttacctagttggttaatagctcaatttttactatagaaagtaagaactaattgatccctgatcttttaatctattaacatgttttctcccaggcatggaacaaatcatttttctcttttgtagcacacagcagcaggtcttctttcctttctccctgttacttaaagtttcttagtatagacatctattctgtaaagtggcaaaaaaaaagggggggggggaccagaggtaacacttctttttttgctttgttttgttctgttttcttatgttggcttatttcctctttatagaagaggaactaaagaacattcttctacaaatgaaaatgataatcactatgttgcgtagaagttttgtttgtcaaggatgcaaaatttatttctcttgtcaaaacctaaaatagactgtggattttccacgtttatagcaattgaaatatatatattttgaatgaataattacttgagcttttacatcaaaaattattctaacataaaatacaatgtatttggaactgttccctttgaatggccgatttttaatagtagtactatgtaattttgattgttatagtttcaaagtctttctgaagaagatatagtgatgaagtggtctatcattcttttcatgggaaagaagcatggataagaacaacaacaaaacaaaaaaagccaaggaaagattttatttttaaaaacacgtataatatataatacttacaaatatatgatatgaccctgatggatacattataaaaaaaactgtatctgtactgcatgtagaagccaagattttcaacataataaggcctcaagatctaagagaattagacataggcaaaactgacacaacttttcatttaaaattttagaagtagggctggaacttattcggtggctaaaagcaccagctactattgcagaggatccaggctggattcacaacccctatatgatggctcaattccagtgtcagggaatccaactccatcctctagcctcagtgaacactgcatacacacattgcatagactcaagtatgcaggccactcatacaaaaaaaaaataaaatcaaatcaaaaaccaaagaattgttatttttaaaagtatttaattacctattttctattgttgagttgtttcgtattttaattaactgaaagaattttattttacagtataaacatatagtaatgttattttaaaaaataagaaacaaaaataggaatcaaaataaaacacacaattttattaaatagtataatcatgaaaactttgtcaatatcaacaaaagatgaaaactataaagacaagaaaattagaaatacatagtaaaaactaaaattctaaaataaaggctatgaaaacaataactagatcagaaatgaagtttagaaaaccttaacagagaggaaccttgaaaaaatgtgacagaaataaggttcaattagaaataaattttaaaaattataacaaatacaaagaaactagagataaattcaaaactatacacaactaggaatatagacaattttacaatcttttacaaacctaaaatagaaagattaaaactatgaagattcaaaaagcaattaagttgcaccatggttcaaatatacagtattaatgggctatgggcaaagttctgctaggaatagttgttgccctgaagtgctctcctatcctttgagtcttagagaccctaggtaagacaaagataaccacataggctgaggtactgttagaagtaccagcaaaaagaagctggcaagaagctacatgaagtatatattcgccaacatgcaaatagctgaggaatagttttcctctactcaaagacaggaaggagggagggagggagggagggagggagggagggggagagagagagagagagagagagagagagagagagagagagagagagagagtgagtctcactggagaaacatgccattcttatgtgtggggcccatatccaacagttagttgaccaacacaatggcatctgcagaggttcttggtctcataatgttaattcatggtgtttctcccccccatatcttaaaggtcctctgattatgtattagagcttctagttttgtgagttttgcattttttatgagattctctagtacacaaatatgtgtgtctctacatctatagaatcatctagaaatttttctctttggttctttttcttgcttggctgttgcgttatcctaatttgtttgttgtttgtttatctttattattccttgatgcttgtttgcttccttataagagtcagaaaaggcagggagcagatgggaggggaggtgtaggcaatctggaaggggtaggaggacagggaaaacaataaatatattatatggaaaaacaatccatttttaagaaagccctcaaaaaataaaacggaaactatcatgccaagaacaaagaaattaaaacaactcatgccaacagaaattaaaaaattgtttgaattttactgacaaggcttttaaagcaatgaaagtaattataagcttattctcagaaatgaacaatgaaataatgcataagaaacatattatttaaacttattcactaaagcatacattatttcaacacaaaaattacaaatcaatgctggatgaaactatggtataactaaatggaaagtgctatgccatgcttgagatttagaaaatccaaagtgatgaaaatgacaattctcaaattgatttatccaatcaattcaacccaaatcaaaacatcaaaaataaatgttattcatgtaaaattcagcaaacagattttaatatttacatggaagtaaaattagtgaaaacattaagaacaatgaaaaagtaaagggattctcaccatctgatataaagacttgctctttgttctatcaaggtaaaggagtcatcaagatgtgattttgatcaaagaacaaatgaataagcagagaagaaccaagtctagaagtaactcacacaaaactcaatttcaacaaaaataaaattcagtgggggaaagaaagctgcagactagaataacacatgtataacatgtttgcatatgatcctttaaaaagaatacattccaaaagaaatagttcataatcagtggaaagaagagtggggaagataattcacaaagtaatggttaaaaggatggaccatctagtgattgccatatctggggatccaccccataatcagcttccaaacgctgacaccactgcatacactagcaagattttgctgaaaggacccagatgtagctgtctcttgtgagactatgctggggcttagcaaacacagaagtggatgctcacagtcagctattggatggatcacagggctcccaatggaggagctagagaaagtacccaaggagctaaagggatctgcaaccctataggtggaacaacattatgaactaaccagtaccccggagttcttgtctctagctgcatatgtatcaaaagatggcctagtcggccatcactgcaaagagaggcccattggacacgcaaactgtatatgccccagtacaggggaacgccagggccaaaaaaatgagaatgggtgggtagggaagttgagggggggagggtatgggggacttttgggatagcattggaaatgtaattgaagaaaatatgtaataaaaatattttaaaaaaagataaatacctaaaagacagctcatgatcctgagtcatcagtgataagcaaatttatactaaggtaaaattttatttcacactccaagacaacatgaccaaagattaaaagagatacagaatacgttctagcactgcttgtcatcttaggtaaaatggcagtatcattttacaaaagcattcttgcagtgcttcttaaggttaaaaatgttatttacttcacaaccacaatcctccaaagtgcttcttcaggagaaatgaaaacacttcaacactaagaatgaaaactttatttgtaacagccccactgtcatgataattctattgccaataacaaaaggataataatcaaaatgcatacattaatcataatcaatctaaaacattattttgccatattgtagagataatactaggatattcccattaaggcttctgtattaccatgtttatccctgttatgaattacctttaaaactgagcagcaatataatggttgccacttttgtgactggtgttagaagcaaatatgaatgataaatttttatattcattaataattgccattgtgcttagaaatgatatatcatatgacatgttatggtttttgttttgctttactctgaattttgttatttaattacctaaaagctgaataaataacatatttgcttttctattaaaaaaaaaagggcaaagcaagagtaatcttctacaaacttaaatgaataaagtaatactgtaatataaatataacaatgataatgtatcattactagacacagttaatattcattctattgttaacatatttgagtcttatagctcaagtgatctacaaaaagataactgtttaaatacctatgacatcatagtggatgccaaaaagactactctgcattttgatcagtcacattagaagatggggggaaagatctttcagaattggatagtagcatattacagaagtagaaataagggcatttgactagagaacgatgttagtggtaatactgtcctaagaattgttcagaatcactagtatacatggttcttcccaagtatcttaaagactaaataatgtgccatcttacacatgaccaaaaataaggcaaagggttgagaaaatatgagacttaaatcatttaattcatgaaataaagcattagactgcatgaaaattggaaatattaatacaggtctatttttgagcttacttgtttggtaaccagtacctacagatacaggacacaaaagcacacatctacatgtttgatgaataaaatcttcctttttaagaattaaacaccttacctaatcacaacagattccctcgtatagccaccgtcatactctgtagtttcttctagtgcctggaaatctagattctgaaaattatagggggaaaaaaaagcaccttaacatccatagtacaccaaaacaaaaaacaaaacaaaacacccaaaacaaaaaaaaaaacaaacaaaaacaaacaaacaaaaaaaagaccttttttgtatatgtctttcttacccggcttccacatataagcaattcaatttcttctggtctgaataagtattttaagggcgattcattagtcaccatatgaaaacctctgcgaaatgccttgaattgtttttctacagatttattgagaatgtagtctgaatagagattgacaaattcctgtaggaatattaacaagaaagcatattctatacaaatgaaacacaattagcttttggactagttttaatacccaccctccaccccaagaaaaccttcagcagtattttttttgttactatgtttaaaaattagatttcagagagttggttcagtgcttaaaaaagcattagcaactcttgaagaataaacataagtcttaaaaaattaatcacatgttatatgtacaaagaaaattattttcacaatttctcacttctgacagatataaaagttgtattcatatgcatagttatacattatgattctatgagtaaatcaaagagaaattatataaaatgtaattaatagtaataataatgaaataatgtaaacagtaagattaaaataaaagatttaaaaagactgtatatatatataacaacagaacctctagtatgcaatataaatttgttatgaatactgaacttgagaaaaccagaatgtctcaggtttcctctggaaattatggtactggtaagttagctactgtatccagctcagcaaaaatgttatttgttggtaaactaagctattataacaaattataaaattttatagtttttataactacttcaaaccatactaggtaattctttgaaaactttacaaattataaaatttgttatagtacaaatgtagtttgtatcatgacagtacaatatttcaccaaaaataatagtataaattaatatatcttaaaattatactatgtaatattttcttttgaagctaagttatttcctattgccaagtaaatagcttttaaagttagtaaaaaccaaatctaatgtgaataatctgatatgcataattagatctcatgacagtacaatatttcaccaaaaataagtataaattaatatatttcttaaaattatactatgtaatattttctttttaagctaagttatttcctattgccaagtaaatagcttttaaagttagtaaaaaccaaatctaatgtgaataatctgatatgcataattagatctcaaatggaaaatgtatatacacactaaaccagatgtcaatcactgggctctgtatacctcttaggtttaatatggtaaggccctgtttctagcgttacattatagtaatatttacccattcaatcttttgtagtctgtttagtctttctctaaaggggaattaacaattctgtacaatcacataagctcttatctaagaggaaagtgtagctttactatttagataaatttgtttatgtaaagtttttataactgcttcaaaccatactaggtaattctttgaaaactttactgctttgaaattatatatttataaaacaatgacaaaaatttaattaccttcctgttttcatttgtaattggaattttatcaccattttcttttagatcatacatcattgggttaccaaaaagatctgtctgtgatatctggaaagtgatcatcatatcatcttccacactcccttcatattccaataaatcctttaaactctgatataaaacctaacaaccagaaagagaagtgaggttgccaaataaatactaaaagaaataaaaataatagattgttcattctttgtagaaacaacttgtcaacaaaaatgaagccataaatattccacatctctcaagtagtttaataagatagaaaggttgtcacaggcaatgggtcaatcttaaaaattcttcaaatgatcagttcagcaacagatttcataccatggtctagaatatacactttctctccatgattgtggcagggtacaggaaatgaggaaaaacaaacaaacaaacaaacaaacaaacaggaaaacaaacaacaaaaaagccacacacatatcaactgtacctatcaacaactttactacatagactcatatgggacattgaaaacatgatgttttcaacattttttatggggtcaatcaaaacatacttgataggatatataaaaaatgatgtttattatacttaaccagattaaaagtattttactttactaaacagcagtatcaacaaaagtttacaaataaataatgttcctatataaactgagataaacttctgtatttagatacaatcttaaagactattaacgaaggacaacttactgggtgagagtctcccaagtcacgaaaggttccttttttccccattagcttcctgtatacaaccatgggaaaatggacatccagtatacaattattgtaaatagccagacccaggactatgccaatcagagtaaactgaccctcagtttcaaaagaagatggattaaaccaaaataatttcgtagcttcatcatatgtgaacatacctataaagaaataattaaaagtcattttatccacttaatgactgaaaattacatatgaaacaaatgcatgattaagtaaaaaaaaaaaaaacaattggagaaagttgattaactttaagttacttaaaattcatatcaaatctaagctaatataattttaaaaaatattttgtgatctttcagcttcacatgatcttcattattcaaagccaaagtccagagattttttttcctatcatcattattttatctaggtgaacattaagagatagtcttttttttctttttttacggaacatcaaacaataaaataaaacaaaactaattgtatatgcctttcaatttttctaagtttattttcagttgcttctcaggaaatactttttatacaaagtctaacaagctgggggagagagtgggctgtataccttagcacttggtaaaatgagtaaggaaaattatgagcttaaggttagagtactaatacaatataaaaagattgtctaaaaaagccaaaatcaaaatgagcaaatcaaaaagttttgggaaatgtttttctaatggaacaagagtattaaaaaacaaataataaagcattaaaatgtactttcaggttaattttaatatttaaaatgtttccttattttcactttcagttttaattaaaaagaaaagtacacttttctccttgaactgtagtaatataaattaagtctaagctttttcttgcaatttaatatttgtggaatactggtttcacaagtattcaattcatacttgcattccagcttgaaaaatgtgagttatgtatgtctgtatcatttgcatgccaggttatacatccaggtaatatcaaaagttccagttcacaaataataaatctgatagaatgtcaccaatggatgctcttggtctcaaggacaattaagctataaattaaccagaggataaattatataacctatgattctcatgacttcaggttttcaaatctaccactctaaggtttttcaaattaaatttccctagaaggcaactgtgttctactagaatatttgactaagtaatatatggaagaacctaaattaagtgagtgatagaacagctcctgaagcagggatatggcatactcaatttttttactgcttaccataactgaaaatatttataaaccaagtttatactttaaaagactaacacaccatcataatcatatcactaatacttaccaatatctggattaaaaatttcctccacaaccaactgaaaaaactctttggaaacgcctccctcatctactccttgttctccttcaaattccacatacaactgcttcttcaagtctgcaggattttccatagcaatcatctctagctgttgattgaaaatataaaaaagaggacagttgagaagaggaaaaatgtaagatataagtagaagaaaataagaagcagcaataacaaaacaatatggaaagaaaacaatgaattttgtttctgaaaagaaaaaaagcaaactgacttacagtttttggcaagatttatttcaacacacaagagtatgtactgtgtttaagaagctatgcatttcttagtaaaggatatagccaaaatgctgttgggggtggggtggggggaatagttgcaattatgtcctgtatatcttcatctttaggggtctaagggcctatgaatttattctgtaaagaatctctatattggtctactttaactaatttgtatgtcttcatgtatgtatattcacatgtctccttccacctaagatgtatttcctcaggatctgtccaccttgtttgtcaggaaaggatctctccttgacctggaagactgcataacacaataggttggactgtcaatggcccctggcatctctgccagtacctgcctacctagcatcaggactacaatgcccacttcaagtttcttttctttaatagagttctgaagattaaactcagttcttcttgcaagttgatctaccttctcagctcgcatacccaattttcaggtcagtattcattgaaatttattttcagcagtactttgttggtgaacatataagaaactgttctttcacaagttccacatatcaccactaaatattaacatttaattactaagcttcaataaatcaatcctattttctaatgtattacagaaacagaggtaatattcttcctactctaatggtatatgcttaatatatcatttctaaggagcaaaactgttaacatattacccttcaaaactatagacttttaaaattcataaatttatgtccccaagaaattaataggtaggtctgacactttacagccaaatatatagatttgaatttaaccttagaaatggagaacaaaattataccaacaacagcattagctagaaacctgttctaagacagaataactttgtacacttaaatttccatgatcatcttagctcaaatttggtcccaacacaatatactattattactgtggtttctcccagttctcaacttgctaagaaaacatgttaattattgattcaaaggcttgttggtttcaagacagcatacatctgtccagtctctacccttttcccccaattctggttctagtatgttctattatgatcactaaaaataattttctatatttttgctttcgtttgaaatgtaaaataagcataatgagatagtatcaaataaataagtgaagtgtgtaaattaatgctctaccattaactctaagtttgaagttgcaagtattgtcattctagtaatttttaaatattccatgttttctatatatgatagaacaagcatttcatcccagcactcaaactcggtaagtttagtgcagttatgtctacacagaaaatctgagtccagtgagagctttatagtgattctctatctaaaatatgataacaagtaaataagtatttccagttttgctagaatatttaaccacatgattttaaaaacagaagtattcccggaataagagcagcagcagcaacaaattatgaaacttacagctcactttacaattaaaattgttctgatatctacaactccttagcaagtaggctgctaaaaccattttacagaaagtcccttgaagtaataaaaggataaataacttaagaaatagtaattcagaagagaagttttaatccagggagcaagcttatagcccacagtttacctacttttccaaagaaaatagagataatatttgcttttagattttgtgtgacttctttggatatcaatattttcaactatattcacatattattttcagaatcaggatatatttgtatataatttaaaaatagttggcagcttaattctgtaagtgaaaatgtccaactagcaatttaagaagaccattctcaatgttgccaaagtgactttgtaaattcttattttgtttgagatgatgcatcagtagcctgtctttttaaaaactatggtaacaaaacaaaacataaaatttaatactaaccatacacaaaagccattagcaaagaaagtcacattatttttttttccttaaatatagtaactcttgctgagaggtggtagcacaagcctttaaactcagcactcaagaggcagaggcaggtggatctctgagatctagaccagactagtcaacagagcgagcaagttccaggacagccagggctacataaaccctctcaaaatacaacccgcccaaaaatgtaactcttagaagagacacacacacacccttaaaccattgtttcatcaactaaagaatagtataaaaaaaaaaattaaagttatattttaaaaatgaatttgtaaaatcaagctgtcttacatgtaattggatacatgaaaactattgggatatacttaaaattctgaaaaaaatataagacaaaataggtagtattggcttcatagatagcgctggagaaaaaatacactggtattactatgctgtattaatgtacaatagtaactatcacttcctaactgtacttctcttcatactaggaaatctcactctcatcaactgttaaaatattattcttaatttatttggcaatacaaaatcctagagagatcattttttacaagctgaccttataggagagcattccaagaaatctaagcagaatgatatactgatttaaaaaaaaaaaaaaacattctataaccatatcttcaaggatcaaaaaaaaatttagcgccatcatttaaaacctttagacagggctggagggatgatgtatcagcagttaagagcactgactgctctttcaagtcctaagttcaattccaagcaaacacttggtggctcaaagctatctgtaataggatctgatgctcccttctgatgtgtctgaaaataaataaacatgaaaggaaggaaacaaggaaagaaggcgggcaggcaggcaggcaggcaggcaggcaggcaggctaaataaaacctttagacatccagagttaccatctaaaatcctatgttaacataactgaaaacaaaaaactactaatgatactatttaagttgaacaacactcaaattagctctatttaaaaatgtttagactctccaagaagagtaatttatacactttgataaaaatctaaatatgactttcatttctataagtaaaaatctctctaaatttctttcttttaaattattatatgatgctaagctcttatcgtactgactacttcatctcccattctggttgtaagaaattattttgaagataaagggaagaggattccattaatttcttttttttttctttctttctttcttcttcttcttttttttttttttttttttttttttttttttttttacacgagacagggtttctctgtgtagcccaggctatcctgaaactcactctgtagctggcctcgaactcagaaatctgcctgcctctgcctcccgagtgctgggattaaaggcttgcgccaccacgcccggcttccattaatttctattagaataattttaaataagagaaatcacattaagtacaattctattaatgaatgaattacacctagagcagcacagaaaaactccattattaaagcaatgtatgtcaaatgatttttttaaatcaagttcttgttgcaataggtatttatactaagagaaatgatggaagctcagctagacaatgcatctagactttcagagaaattgaggaagtaattcaaacaactttttcttcatcgatgtgtgccagctcctgggtttttggacttttctttccaattctacaacttagcaattatttttggttaactatggaaaattctagaacttaactaaatttattcatgtcccataccactgtcaactcctattttagtcacactgacttcattattcgttttaaacactggcaatattctacacatggatattattcaataatttatacttataaactgtactaactgttgtttcccaaatattgatttgtagcatagatgtaccaaaacatgtaaagaacagaccactacattttcatatcagaattctttttttttttttttcctatcagaattcttagtctgaactcctaaaagtccagaccttaaattctgttgctgtgtttttattttctgggcaattctgcttttagattgtgaacgcagtctaaagcatctcgcacatggcaatactgtctctggatacatctgatcttattccactttttaaaaaaaggttttaagattttatatatgctatatccttgaaatcactttattttttaaaaagaggagaaaaatgtgccatttatttgctggtggtagaagaaaacatgtgccaaggagttaattacgtcttgtggattaaactcagtcatcaagcctggtggcaagtgactttacccaataaaccaacacaacagcctacaaagaatatctgttttttgtttttttttttttgttttatttgtttttttttttttttaagactgttaaaacttctacactaggattgttgttcaaatggaagctgggatctcattagtatttatatctgtataattttctcgttaaaaaaaaaaggccaaaaccattcaaaataaagcaaaagaaatattggagttttttcctttttagtagaatttgtagatttatttctttattatttatttattgcttagtacatacaaattttaaaaaatagtaccttatacttttatactgactattctcttgtgagacagatcttctaaaaataacagttgggggaaagagttgttatactgattgaaaataatgaataaacttttgcttacaaaaaagaattggctaggagtgttatacacacataattttagcactcaagtggaaaagataaacaagatcagaagtccaaggataggctaaacattctttattaaataaaaataaaaagtgatttccaggacagccagggctacacagagaaaccctgtctcgaaaaacaaaaaacaaaaacaaacaaacaaacaaaattaattctaatttactcgcctactgtctaccattaagccagctaatctaattaacactgaaatgtgagattcaatagaaaacttacaaaagtcacatatgtaatcttttctaggcctcacttataaactaaggagaaaacggtattatttccttcatagctcaaggttagggttctataacctttctttctttctctctctctctctctctctctctctctctctctctttctttctttctttctttctttctttctttatatttattaatgttgagttcactgcaaaacttctcattccttctctatacaaccttactatgcagttcaaaatgaccgggtcataaaagattgtgattaacatgaatattctgccaagtttttttatgaaagaaagaacaaggtttcaaaacaatagggatttgtggagaataaagacgtggaaagagagtagaattccatcagttcatatgtgggtattcttttgaatacagcttgctgtaaacctccacctttttgctattaatctaatatgaatataataattatcctttgctcagggtcatcaatttgatctctaaagtctgagtctttgcttctatttctaaccctttcccactagtatgctgaaaaaccaagaaattttagaggggttcagttgaaaatgatccagaaagagaaaaaaagaggagaagtggaaaagaaagcaatataggacaaagaagagctgggtgaaactcttaggaattttctcaaaaagtacctatctttgtaattctactgcttatcaatgagacaaacacacagaattgatgaaggccagggcttctataaaatactactagtcgaatatggatattatcaaatgaatcatgtcaaaccatatgactagttcacataaataagatttactagcaacagtttgttagcataattacaagactcaactgttaattttactccaactacagaaggggctaatttcgtcctaaatgaaattttacaaatactatccaagttttaactggttcttaactcaataactttattatagaaaaaaatagtataagaagataataaaaaaaaaatcaggtaggacaggtgcataaattttttattaaatgtgtatttagctcagtcttaaggcttttcagatttcgacaatccattcccccccaaaaaaaataaatgttcaaataaatattatttgttagttatctgttaatgagttaatattatttgttagactataaggatgatgcttcaatctgtaactagtactaaatcttacatcaagtttatacaagaactagcactaacaggaacaattaataccaagggataccctgaattacttatatataattttgttaatatgtgactgacaattttcaaaccaaatttctggtttaactgacagggactctgtaatttttgtcgtctgtagaaaaaaggaagacaagaggcaatgttatttgaaaacaaaaacaaaaatcacgcagtaagaagttcctgacttcccagttaaatcatctagatttacctggtattactaacattaattccaagctcccaaaatagccactttacagaattttcaagattcatgttattattatttaaaaaaacaaaatcctacaatgtcacacaagacagagtggcttagaactccaaagtcttattgataatacagactaacctttcctggtcatatcatcaagttcacaatagaaagctgagttgtgttacacataatggaatttgaagagcagctcttattcttttacaatgtacatttattgcattatttcttccaattccatcttccattcttaaaaatgtgtataacaataccatttgtcatgtgttccaatctttgaaaaccaatcttttcttcttaatggaaatatatgaggctggctttcaagattcagaaaatccattccttttacttgctttgtgcctgtctgtctgcgcatctgtgtgcatatgtatgcatgcatgcatgcatgcatgtgtgcatgtaaatgccaaaaggggaaaacgtatgtgtggaggtcaaagaacatcaagtatcagactttgctttctaccaactgagacagggtctagttatttgtcagtttatatatcagattagcttctgaggatttttctgtctatactttctatcttgctttaggcagtactattacaaatggaactaccatatcctgttttacatgtattcagaaaatccaaggataagtcctcatgtttgcacaacaaacgttttaaccactgagtcattcccctagtactagaaaaatctattcttcttcaaaagagaattatcattagacaaccaggataccagtatttttggtaagaagcaacaaaggtgtagcaatacagatcagaaatgttaacataatcctatttttttccaaaattatagataaaatgaataaattgaaatacatcactgtctaggttttagtttaattccaattttaaataatagtcaaacttacccggaccagtgcatcatctataatatggtcacgtctgactttgagtctcaaatacggattcaactgctgtccttgaactaggctgtaaagaacagtgattcttctttcactgtacatgcgaattctattgtcataatataatcccagattctttgtgacagcattcaatataaagggacatgtcataaaagagaatttgttctctgtttcaactttgaaaaaggtataatctttgtccatttctagaacatcattcagtggttcattaatgaattcttcaaaggagataagtggttttcgacagtctagagttttaacgccaagttcggtttctagtggatccactcgaggacctttcttatttcttctttcatctcccagaagctcctgaagtgttaattcgctggactcaggtatgggttcttcatcatcttcctcattatgatttgtgtccacatcccctcccactacatttgcatagtaaaccattttcaaacactttgaagcagcaacaatggcatcatcatcattcactagatttcggctattaaattcattgcttatgactttgtaggtaataagttgctgaaatgtttccatcattctccgaatctggtcagcactgtatttagaccacagcctaatcagttttccttgagcttcaaggggtagcttacacatagctttgcaaaataatggcaacgccatttccagatattcaggactgtggagattactattctccattacaataatgaacaaattgagataattaggatctcgagtatacacattatgatatgtcaaatcacattccacgttaggtgacagatatacaagtgcattcaggaaggcagtttctaatttttcattagcgagcaaactgctgtagacccttctaatagcatcaatatccacagtcacatcatcaggacctaatttttgtacattgttgtctccctgtgaactatcacccatccttgaagaagatgcttctgagtcttcttccatagcagcagcagaacatgcagctttttccttttcatcttcatccttgtcttcatccttttcttgaagagatttcaattcctcctttgtgtgctgtttgactttccgaaagctcagaaccagtgcctcagcactagaaaatattcttccaattacacgaattaaaggggaataatcctcactctctctacaaaattcataaatttcatatactttctcttcagttaggtaaatcacatctagaaaatggaaagaaaaagaacatttatgttgtaatatacatgtttattttgttaaaataattgctagtgaaaaagtaaaatatctaaacattctggacttgatttagaatttttaaatgatgtaatttacttattaacaagtaatcccaacaatctcaccctttcttggcattcattgaacaaaatataattattaattatgcattgataattaagacatgccttgtaaccaagacatgtactggtatgtaacattaattgtaggtatgaacaaatatatatacttgtcatttcctcattgtactttattacaaccttaacaaaaagctactatataaaatcctgaaatcattttcctttgcattgttctcaaaaaactaaggaggtaaggttttataacaaggtttccttagccccttcatttgcaatcaactctttctatacttttgtatatactaaaaccaaactgactcatcttatgtattcctaatttcttccagaatttccattcagaggctgaggaaaagatattactactcatgtaaactctactgaagttaaaactgctactacaactactactacctatgaccattactcaggttctaacaattcttaacagagcaactggaaattattacagtcatcagtcatttaaaaacaaacagaagaaagaagctaagaaagcaaaaaccacaagcactaaaacctatatttattttctcccagaaatagaattgggatcataaaagtctctagcttctcaccactaggccaaatgtaaatttcaacaaaggctttaccatttcaggttaacaaaacaaaagatacttatctttttggaaaaaggtaacattttacatattaaagttttagaaagtaatatatttatcaaataataatgttgaaaccactaatctctttcaccaaagagtaacatattataattattaaacatttaagttaggataattttatggttacattgataatacacctcatacattgccaatatatctaacatgtaaaatctttattatgattgctacatattattaaaggtacctaattcaaaaataagaaacaatataaaattcaagtcctcattgatggaatggcttccaaaacataaaccacaaagcactaaactatatatactacaaacctgtctatggcccattctagagtattgatactttttaattttatgatcttcaattctttcttttaaaaaaatgttctatttacttattagaggtgatgagggtattgagctgagttgataacctaaaagaattaattttctccttctacagtgtgagtttcagtagttacatgtccctatctgaggcagcatggcaagccaagttcaattcttagtctactaagaataagtaaaaaagaaaacactaacatggagctcatttctcgttattctaactgaaaaaaatacatggaatcttctttaaccattcaagtctaccaaatttctctaaactgtaaccaaaacacagaaaatatcagtaatgaataaataggcagactgttagaatataatgttttatctccctatcattgaattataaaattagttagaaagtgcaaattctacatacagaacaatatacatcctgcctgaaagagaataaagctctagatccacacacctttgatttgcaatgtcttcctttcagagcacagtcattaaatcactctgacattctagtaatacaaactactattcattgatatttgttccacgtagtactctacttaaaatgtttaaaatgtttatctccatctcccccacccctctcatgtgtgcatataaatcactgcaatcagaaataaaaagttctaatctgggtatcaacaaacagttaagtaaagaaactttttttttttaagattcacctgtacattctaatatatgtgtgcttgaaaactgtttgagacatggtttcacatagtagaaacagaactggaaatcagctcaaaatctttaaaacataacattttatactccaaacagtttcacgcaaaaacagagttgtgatacactagctgataactacacctctaactaaagtgaacaaatataattatcaaactgagggaaacatgattaagcatatataattcaaaaatattaaagaagtaaaggcaataaaatttggagtgatccacaaaaacaaagaacctgtaaaaaaggaacacccatgggctaaaacaaggcaactatatccattatatactagatttttcccacagttagttgcattcaactatgatgggatactatttttcatttactgttactctgtcatgtccactctgttgtagaaacatgtataattgagccaatgcaattttcacattcaaaatattgattagcattcacctacttatctacaatgtaaacaaattcatgaaataggactggctatatatttttgagtagcaaagctgaaagtttttttttctgatttttctttagtcctattgtgaaagtaatatcatgaagttgtactataattttatttcactaattcatttaaacatgtttcaagtgatagtggaactaatccctggcaatctgaaacattcaattacttccattaagagaaaaaaatagattgaacaaaatcaatcatgaggcaaagtaggaaatttgaagaattttcaaaatatagaactatttttaaaatactagatgcattggggacatagcttaatcgtgagtgcttatttttcactcatgaggctatcctcagtaccaggtatcagagtataaaactttaatttcattactggggaaatagaagtgtgagtattaaaagtacaagaatagtgccacttaacttgcacaaaacaaaatgaaacgaaaccccacaagagctgagtaaagactattactggtaagttacgtccctaagcagtatgaaaatatctaattcctgacgtagagagggcagaatgtaagaaggaaaaaatgtaattttcagataactattgcaaaattttaccctgctttcttaaaaaaagaaaagaaaaaaaaaaaaagactactttacactttatatttgtatttctccttttaccacagtccctggagttctagagccgatactaggtattcacggcaaatgcaatgtacatagtagatttttgtgacctaataaggtattagctacaatataaatcattacaaactgagttcaactcatcatcatattaatttttagagtataacttgcttctgactgacaactaatgaatcagtaaaatataagaataaaatgtaaacaaactaaataccagtcctttaccacagtttaccagaaaaggtgacttttactatattatagtgcgataacttaaggtgataaaaaaagcaaaaacaaaaataaaaacaaaataacaacaacaaacaaaaaaacaaaatcaaaacaaataaacaaccccctccacatttaaatctgatatagctttcaattaaccattttgaattgaaatataatctcttacctttaaaatcttttccttccttcttgttcatttttatctctgagttgttagatgcaccttttgagttctcaaggtaagctgagcttgctcctttcttggagggatgaggatcacagagttttgcattaattttataaagctcaagggctttaatagctgctgcattgttatccatacgaagaaaagttggacaggaagcacaaaactcattcgtgcaggcctcatttccacagccctcagttaactgatggtagtagcgttctattagatgctttgcagctgctcgcttcctgtaccagacattcaaacaataagcacatttattagtatagctcagaaacaaagcccaacagataaggcaaaagttagctaagcaataaagcaataaactaaatatttagatgtagaaactggaaattcactactacctcccaaagtgttagtaaaataataaacattttctaaaaaaactgtgataaactatgtcagcttataagataattttaatatggcaggcttttctttggtttaaaaaaagataagcttaagttgatggtataggacccttaactatttagcagaaaacaacaaaaacaaacttcactgctacatctccatggcagtttcccttttcactaatataaaatcactaattcattttaacagtttcaaatacttgatttccagttaatatcaaacttctagagattaaaattttttactcagtaagtaatcatgagatatttaaaagtgctttataaataaactatctaatttcatattataccgagagagaagcaccaaggcatacaaccttgagcccatacttgtcactatcttcattaaatccttgtcataggaaagataaaggtttaaacttccatcaggggaaactcatattcatcttacttcatcaactttaaacattaaaattaacatttgattaacatatttttcatgcaaagtaaccaatacaattaaaggaatgaattattttaccaaacaagaagttgttctacataacctaaattctataatttgactctaaaattctattcttggagattaccacaaaatttaagttgaaatgtatatctggcccataataatgtcattctaaggaatccgtttggttctatacaagcatgggaactgcaagtagaaagaatctatctaatttcattctaaaacttcatgtcattattttagatagaactaagtgactaatggcactagagataaacaaatatggcactgataagtgactttaggactatgtcattctttgtatgacaaagaatggtatgtcatacgatcctaactcattcagatacttatatttagaaatattccctgtatatttaccatgcatagtgtacaaaggccaagcctgatgactcaagtttgatccctgtatccaacttggtgaaaggagagaactaattaccacaagttgtcctctgaactctaaacacaccaaaacatatgcccagtcacatgtatctacagaaaataaataaatgtgatgaagtttaaaatgtatcacgaagttagagataccacttatgagaaaaattcatcaaaaggaagacttatttccctattatttatggaaactcagcatgcttaacaacagcaaaccgcttcaatatactgacagcatgcaccaaataaaataattaccaactactttaattttgttacttccttaacaaaagctagtgatcaagttataaatgtaggatgaatgtttcgaaatattaactatttttctaaataattgactgagttaattcttcctagctacgttttttctgtaagtatgtacctaaacactaaaaatttctaagtatcagtacggaagttttaaaacttcatctacgtgatttaaatagagccaatgtttatgtttatatccaggatttttaagcgttaatttcaaagttcaaaacactagttttctaagagtactaggccgcccccccaacccatacacacacacacacacatacacacactacttctttatgtgataaagaactctcaatactgaagggagaaatgagaccatccaaaagtcagctcaatgtaattagttgaatgaactaattttctaggcctcattttaccaccttatgtccttataatttgtctagctagcactctctacatgccaaataataaactcagtacattgtcaggtactctgattatcatatgaaacttgaacttgaagattatcttctgtctacagctagtaaaagagaaagacctgaaaagatcaaatcttataattgatcttatgctatgtccattaaagaagtcaggacaattttcagcttcagaattcaatttatttccaatcactgttttacagattataatttcagaagaattaattcttaataccagcagtcctaaaaagttttaagggggaaaaaaagacctaagtaatatataattagaaaacaaaatcttccaaaaaattccaatctaaacttaacaaccatgtgtactatctgggtacagtatagaaactcctgaataaattatatcactatacttaagatatcggtaatttattgaaaatggatatgctaagcactttataagaagactcagtctgtaacaggtagaaattcacaattttgaggccagattgtttgggttcatgaacagtttctgtatctgagttaactacttatttagtctctttctgtgtctcagcttcctcatccttaggatgccagtatatttcagaattcaaatgatttaagaattacaagtgtttagactatttcagtaaattttggaagaggtaggaaaaaaataggaggtgaagatgagcaaaatgcattgtatcatatatgaaatcctcaattaatggaatagtatgtattacctgctacatgctaggccctaatggtaagtatcagatgctattgcaattgctataatttctatcatttgcatgagtatatgacttggtcaagagaactccattgcactaaatctgaaaaattaaaatctaggcttaattccaaaatttgaaattttagcattactaaaggggagacagcagagaaaatgtttgaaactgaccagcttttttgcaccaagttacaagtagtagcccactaatactaataattatattaaattaaataaacagaggtcataatcaaccatattaagttgactaatttgattaatgtgcgtttattaatattaagttaattaaattggttaatatgattgaatatgattaattaacaataataagctattcttttctcattataaatgataccattgaatgccaaatgcagggcatataaattcattaaggacatgtaaaaggcctctaaagttggaaacatacatactaataatagcttttgataaccttccaatgctaatccatacataggactggtcactaaatcatacctcatgtgtcaaatctactttttttacagttgaagtttagaatattttatagtcttaaatcattaaaaaattatattttgtttcatgtgtgaaaattgcataaaacttaaatgtctatgtccataatttctaatgtaacatggtaaatttcaagtacttgtatatttcctgtatgttctctatcataatgtatctagccaaaagtaaaatgctttgtcaccttaaaatgaattccctgtgcatgccagtgaaactttcaaccaatcatctggcctccttactttctctctttgtcctcagaagatgaatagagtaaggttctttcttcctacttagtactttaacaaaaagggagtggggaagtaggaaggaacataaaagaaaaaccaaagtaaagttcaggaaatgaagtgaatccgtttcctgatattcataaccaaaactctacaaaaaggaggtagcagttacttttgcctattcatattccactgacttcgtggaaatcaaagtacaatatagtgagtccttaaataaaaatatgccttttttatttagtttataagaatcaagtgaatcctaccagtaaaagtgttcctctttaaataatagtttccacttctttattactttctaagaagccattaaaacggattctacggaaactgatagaagcagatgcagggacccacagccaaacccttgaagagtcctgctgaagaggggaagggagccaaaggacaccacaaaaacatagcccacagaatcaactcagcagggctcataaggggttaacagagactgaagcaacaattggggagtctgacctgggtcttctgcatatgttatagttttgtatagcttgatgtccttgtgtgacaattagcagtgaaagtaagggatgtctccgactctcctgcctgcttttgagaactttatcctcccaatggcttgccttgtccaccctcaatgggaaggttatgtgtgtgcctaatcttattgaaacttgttgttatgccaggtttggttgatattcatgggaagcctgctctttaatgacgggaaagaagagggtagtggatctgaagcatgagggaagggaggaggaaagaactgagaggagtgcagggagaagaaaatgcagacaggataaactatatgaaagaattaattaataactaattgatgttttccacaaatgacaataaagagaaataattttcagtgttctcagtagcactaataacattatttgctgggtcctaagttaatttcgggatagttgaatacttaggaatagtaagtaaatcataataaaaatgataaagttataagatattcataactatatatagatagcatcaaggagattatacactagaagaataaagaattcccacatagttcagcatgagaatcaaaaacagtgaaatagctgccatgaaaacaagaaacagaaacatgaaagagataactaacaatatgacttattcaaagtatcttttttaaaaaaataagcagaataaaaacaaagattggacaaaagaggtaagaaacatatacagcccaagactcaattaacccatgcataatctagtaagcactgcttagtgtctttcataggtaaatgtctcattattttgtaaggggttttataaaggatgtacctttataaaaatcactactcctccaagaaatggtggcttatgcttataatagtagcatatactagactaaggcaggaagatcttgagtttattatgaactttatgtggaggaatcagtaaaccaaatttcacaacttgccccaagttatttttaatgtagaaacttgtcaagagtaaaaaatgtgatctcacaaacaccagagatattcataatacagttaaaaccagtataaggtagggtctattgaagtgtcatcaaatcatgtattacaagactgaaagtacaaatatgacccaattagtatcaggaaccatttgaaagtcaattatatataaaataaggaaaatttcttaaagacagatagatgggtggatggatggatactaaaaatgcttttattcatctttacaacaaagtactagttgtaaaaatagaactgtggaattaaattttcacatagaattatttatcttttaaaatgaataaaccactgtttttggggttttttttttgtttgtttgtttgtttttcacctgcccagtttcatggttagaagaaagtaagtaaacatttacaaatttagaaattgactagtggagctggaaacatagtgtagtagaggcacaccaccaatatatattgtataaatatataaaactttcaaagaatattattttttaaacaaagatcttttcctaaaaccataggttgactcttctttctgtaaacagaaggtgaatattggctgattgtagtgaatgctagttttagaacttgtatatttcctaagtaagaattttgaaaatggaaatctgtcctgtattagtttggaaagagttagtaccactgccatacaaacagcagatacctgataggagactagagtgatggctcactagtcaaaagcactagctgctttttcagaggaacagagttcagttcctagcatgatgtcaggtggctcacaaaactgcctgttcctccagcttaagagcattaaatgccacaggcacccacacacatatagcatgcatatgcatatatgcatatatatatatatataaatatatatatatatatatatatatacacacacatatacatatacacatattaaatctaaatacagtcaaaaccaatgcacaaaacacatttgaaaaagaacacatgtccttgctaaaatcccattacttaaaagaaatcttgtgaagccaaaaggctttcagacagactcatttgagaacatgaataaccactcccagtgatagagatatctcagtagttaagagcactgattcctcctcttccaaggaatccagatttgattctccacaccaacaaactggtgcagtcagctgtgacacctggaggagttacacactcatctggtctccatgggcaccgaccatgctacatgtggtgcacagagatatatcccagcaaaccacagataaacataaaaaggaggaggaagaggaagaagaaatggaggaggagaaatatttactcttaccacctctaatggatgaagtacaatatctaggcatagctatcagataagaaaaagataaaagatacaggaacatttggaataagatgcaagactacaaggtgctaatgtgataaagtgaatgaaaacttccagagtatcaaaggataaattcaaattctaagagagatgaagaatattggaaatcacaaaagagatactacaactgagaaacagagaaaaatactatgtagcaaaaaggaaaagcagcaagtggctccagccaagtggtggtgataagggatatctcatccataaggtaaaacagatgggactgactaaaacaatgcaatagtcttgatcacagaacaagcaagagtactcacaaagaattaattggaggtttcgtcatgacactgacttattctaagtcagcactggaaagggaaaaatccagtttataactgtattctggagaactagtcaggtgtcatgaaaagggatctacatttgtttgaaaacaaacaatcttgggggttgaaaaacatgaaacaattacaaataaggaaaaggggtgaagtcttgccatagtctatgggtgggaagaaagctgagtcaggtagatatggagtagagacttgattgactgagaaactcaagcaaagtagacaaggcttgaagggcactgtgtcaattaaccagcccttctgtggcaaggatcaaaccctacaatgtggaggataaagtgtcaagcctacaaaattggctctgtctgtcatgagggttgctgcctacagtacttgacaactctgaaggtaaggtccagtggagaaattgattccagctgtctgataccccttgcaatgtggtgacgacaggcaggatctaaaagtatagagaccagttctctagaacaaacagtgcttttttgacttccctcatttaaagcatacttgggagacaccctgtggcttgaaagtagccaactaagacagaaaagctggaaagtccctgaaggaaataatgaatgagtgaatgaatgaatacataaataaataggtgaaaatttaaaaaataaatgtaaaaatccctaggtcctgtacagcaaagttcagctagcaaagacactggtattcaaaaacactgacaatctcaaaccgaagatagttttctatgacatctgagctttgactggttccaaatcagcaccagcctcaataacaggactggaatattaggggatgcagaataaattactccaatacacttccttttacttgttattgttttagactttattttttgtaagactattatttacttactattctatttatttgtttgctttctattttgtttgctttctttacttattgaccatttgttccattcccattattcttagtattctacttcttttcatttaaacttgcttcccttttcttttcctgcccctttccccttttttttttccttaagctgctatttctaatttgaccctaaacaagttttgactacttacattattctaaacatatttttaattatcaatggtgctataaatgctggcatcaatcaattcaaagtctatatctgaaaattgtttggttttattgtatgtgttggaggtttctttcctcctttgagtagtgttaaggattgaaaactcaacagaaggctaattacaaataaaactggaaaacatatccatactgacaagtgtacaaattagaacacaaaaacaaacaaaacattataaatggaacaaagttatttcagaagatcagcatttaataaccaataaaaagatggccaactgtttgaaatgctgttcaaagaattctgaagtacatgtcaatgagaagtttagcaaagaaattgagactggtgctgggagggaggatgatggaaataaataaaataattaaaaatctcagtggaaaccataaataatagaccaaatcaagtacaagacagaacagcaggaattgaagaaaaatctgtattcagacacacaacaacacaataagtaaacacaaccaaaccttttagaacatgatcaaaatgaaactaaagaatacatggagcagaaggaacttaaaagcactgagactaagtcaatgaaataacagcagaaattttctaaaatatcgagaaagaaatgaacatctatacagaaagatgtgtaaaacccaaataaatcatggacagaaagaattgctcctgagcacagtgtagctcaaatcctaacactacaaagaaaataaaagtatcaacatactaacaaaggtaaattcactgtaacatccaacctctcactagaaatttttaaagacaaaaatcttttcaatgattactatatccaaagttatcttttaaatgtaatataaaaactttccaaggtaggcataacataaggccacttgtgaccactaaactacagtatacacttaaaggaaacttacacatagcagaatgatacaaacagaggagctcaaggaaaatgaattttgtaattctatatatgaaaaattaagaaagaagcaactgtgtctacataagttaatgaaagaaaaacagaacaatgaaagaaacaacaaaatataaatgtttttagcgttccatttatgagacagattagccaaatgaattaaaagcaggatcaaattatttgttgtctataagaaatgtatttcacttgaacagaagctaaaggaaaaaaaaaaggagactgaaaagtgagtggaaatcaaaaaagaactggactactgacataagtatatgactgtatactataaaagaaaacaactgggctggagagatagctcagcggttaaaagcacctactgctcttccaaaggtcccgagttcaaattccagcaaccacagggtggctcacaaccatctgtaatgagatctgacactctcttctggtgtgtctgatgacagctacagtgtacttacatataataataaataaatctctttaaaaatatattaaaaatgtaattgaggaaaatacctaaaaaaatattttaaaaaatatttaaaaaaagaaaacaaccaatgagggatgtacaattaattataagtatatatgcattaaatgatggtgtacccaagttcataaaaacaagcactaccagactactgtaaaatccaacctctcgggctggtgagatggctcagtgggtaagagcacccgactgctcttccgaaggtcccgagttcaaatcccagcaaccacatggtggctcacaaccatctgtaacaagatctgacgccctcttctggtctgtctgaagacagctgcagtgtacttacatataataaataaataaatcttaaaaaaaaatccaacctctcaccagaaagtacaatatccatatagaaagtaacaagtcaaaatacagtaaaatacagtaataatcttaactttccaaattaataacttatctgatggaaagaaggaaggaaggaaggaaggaaggaaggaaggaaggaagattgattttatctaaactgtaccaaacatcaaatggacttatttcaagacatctaaaaaacatctcaccttctgcagaataaaccttggcagcccatggaactctctaagagataaaccacatttttgaacattaggcaagtcaacaatagtaaaaattactttcttgtacttaacaaataataagagaataaaattaaaatgcaaaaaaaaaactaggtatgctacaaatacctgaagacaatataatacaatcttaagtatcataagagtaactgaaggaatcagaacagaagtgttttaaaggaataagtcaaatgaaaagaaaacacactaggaaacagcaaaatcatcctcagtgaagtaactcagactcagacagataaatatggtatgtattcacttataaaaaaaaaggatattagcagttaagtaaataataaccaaggtacaatctatagagccagagaggttaggtaaagaggggggatccagtagggatacaaggatctccctagaagagtgaaatagattatacagccaactgggagtagatagggagagtaagcaggtgtggggaggtgagcaggtggagggagagatggggttgagggaaagtgtggtagaaacagctggaattggggaggaaagaatttccatgttggtgtagaaacctagtgcattggaaatgtccttgaatgtatgaaagtgaccctaataaaatggtctagtaatggaagatatagaatcttaagtggccatctcttgtctccagacaaccaaagtgagttgcacttcagttaagtgaagagggtcccatagaaattcccaaacagggctggaaagatggctcagcagttaagaccactgactgctcttccagaggtcctaagctcaatccccagcaaccatatggtggctcacaaccatctgtaataggatccaatgccctcttctggtgtgtctgaagacagcaacagtgtacccacttatatgaaataaataaatcttagaagaaggaggaggaggaggaggaagagggagaaaagagaagaggaggaggaggaggaggaggaggaggaggaggaggaggaggaggaggaggaggaggagaagaagaagaagaagaagaagaagaagaagaagaagaagaagaagaagaagaagaagaagaagaagaagacgacaagaaagaaagaaagaaagaaagaaagaaagaaagaaagaaagaaagaaagaaagaaagaaagaaagaataatccccaaacagcctaagctgttgtcaaaacaacaggttgctacctgaaaactaacagtagagccctactgctaaggacaatatccacactacccaatgaacacggagaagccaagctgctgcctgcatggactcttcacccctacactctacttctttggtgtaggaaggtactctacaagctaccaaaagagatatacgcacaccaacccagccacaaaacctttgacctacaatctgtccttcctgtaaaatatgctaaggcagtaggggcaaagaactagtgggagtagccaaccaatgtctgatttgacttaaggcccactccatgagaagaagcctatatccagactgcttggataactaagaaccagaaacctagggtaaaacaaaaacactacttacgttttaaattttttttttaaatcttaaaaaattttaaagtcaataaaatgattatggtatacacattgtatcagtgcctaatctagttactgtcaaaagaggttttctctggcagcagatggaaacaggtgcagagatggagagaccacagtcagacattacatggacagaatatttaaatgggagctctcaatcaaatactttacagcagagagcagggaagcccttggaagagaaggtggaaaaactttaagagccagaggggatggacgataccagaacaagaccctctaaatcaactacgaaagtctcataggaaatgtcataaactgaagcagtgggtctgtaccaggtatgtatgtctgtatgtatgtctgtatgtatttgtaagtgtctgtgtgtattatatatgtatgtatgtatgcatgtatatgtatgcatatacatacatacatgtactacatgtattacatatattacgtgtattacatatatatgtagtatatttatactacaaatatgtatatacatataatacacacacacataggcacacacgcatgtgcacacaaacacacatgtaaaatagctataggtttagtattgtatggtactccctggtgtgagaacgaattaggcttctgactcttatgcctgctcttgtgactcttttcctcttgtttaccaaggcagactaccatgatagtttttgcttcatcttattgtattttattttgtcatgttaaaaaaaaaatcaagaaaggaaaatatattatgatacagaaaggcatctctaacagtgaagtttcactccttcctttagaaaattcggtcagaattcaaataaaaacttaacaatgcacatcacaatctcagaaaaataagaacaacccaaactacaaactaatacctggaaaaaaaaaagaataaagaccagtatagaaattaatgtactgaactctaaaacacagagttctttctttgaagagaataacaattccttagcccaaataaccaaagaaaggcaagaccaaattaataaaattcaaggttaagatgaggacaaaataaaatgtagtactgaaaacacatgaggtctttagtaattaatatgaaaagcaacatttaaaaagaatgaagtatctagaagaaagttataaattcctcaacaggtatgatctataaaaattatattaaaaggaaattaaaaaaaactaaagatacagaaagcaacaaaactgaagcagtacatcctaccaataaagaaaagcaaagaatagattcattgctaaaattaccagttctttatagaagaacaaacggcaaaaaacctcaaagtgttctaccaaacagggaatgaaaactactaaagccattctacaaaaatattattttgagagttccaaaccaggtaagagcacttagaaaagaacacacctcaaacatactaaaaggctataaaataacctgagactattgttatgttaaataaaaaaaaatactgaagtcatttttctctaatatcagacatgtgacaagggtgttcagtttctataatattattcaatgtagcactctgaagtcatagagaaaacaagaaaaaccagaacaaaacaaatgggaaagaaaagaacaaattatctctgtaagtacacaaaagcattctttacttaaggactctgataaacacttgtagcaaaaagaaagacataaccagggcttttctatataaccctacaaagatcccaagaaacccagagagacagagtgacagagacagacacacacagagagagagagagagagagagagagagagagagagagagagagagagagagagagagagaaatgaatatagcaaaaactgacaaatgagactgcaacagttaaaaggcaaatcagtagtgaagagacaaccaaaataatggaagaaaatctttaatgcagaaaactatacatctaacagaattagtatctagaatgtctaagaacaaaaaggcacgtgccaaataaactgatattccaatcctgcactaaattagccctcttcctcaacattgtaaaactcttctgtgataaaaatagaacaatccaacccaagggcatatgtactggagatctgctttagccccacatctgaggtgggacggcatggggtagggagagatgccttcttctacccccctctcactacctacagcaggtagaactggccctttcccttactgattgaatcactcaggagcacaggtcctgcaaattgactataacagctcagaaaagctggctatggtgatgttgcaggtaagctggatgcaaggacattgagagcacaagggctgatcctgcttcattgggtaagttaagcaggatagtgcttgagagttgacctcggctgagaaaaataactcaactacctcccaagcacagacccagggcctaccccaacatctactccaattatgatctgctggaacttatgaagttgccagttctgcacatccaaaactgcaggatctccatgacacagggtaacaacaggatatccaggagtcctggttgaggatccaatacggcagaacctagaggcctcaaaatagaccaataactcattgcaatgaacatttgcaagtagagatgtgtggacaaaagcctagaaaaacacaatacaaaaggccagtaaataaattcttcccaacatattatagttaaaaaataaataaataaaacacagactaaaggatactaaaggatacaagaaaaaagtgacatcactcataaagcaggctcatcaaaattaatatctattcaacaaaagtctttaaagcatgaagtgtctggatcagtgatccttaaccttcctagtgctgtgaccctttaatacagttcctcatgttgtgatgactcccaaccaaaagattatttcattggtacttcgtaactattgctactataatcaatcataatgtaaatatctgatatgcgggatatctgatacgcaacccctgtggcagttatgactctcaggctgaaaacagctagcctggatcctgaaagatcacaactggtaacacaaagcattacacttgtaaaactttacacaaaaattcaaagacaaatagaaattttccatgataaacagaaaaaacacacatctttcaagaactctgattgtaaatggtcttaattaatcccttctccaaagatacaaaataaagaaaattagaggaaaaatctaccaggtggatgttacaattttagacacataagcaacacagaggcgcacaatttcataggaggaatgctattagatctaaaaccacgtgtcagtctcaacagtgactgatagtgggtgacttcgctacccaactctctccagcagacagatcatctggacaaaaattaaaacagaaactctggagttaagtcaaatgaatgtaatagatatttgtacaacattccacccatatactaatacattcttctcagtctatggaattttctacaaaaatcaactacctatcaagacactgaaaaagtcataatatatgaatactgtaataccatacttctttgtatagaatacaatggaataaaattagatattaacagcaaaagatattacagaaaccatgggaactaaataacacattactgaacaggtgatctctgtgagctcaaagccttcctggtctacagagctagttcaaggagagtcagggctacacagagacaattatctcctctagaaactaacacccacagtttattcatctctgagaaaagcatcataaatgatgcacaagaaaatatcttcaaacagcaaatccctgttaaaggaactcaaagacaatataaacaaatggctgaatgagaactgcagaaacatgtaggtgaatcaagtaacacaatcctgagaaccttaggacacagaggatatctcaacataataaaggaaaaacagaagaaattcctggcaaacatgttaaataacaaatgaaaaaaaaaaaaaaaccctcagagcatccttactaaaattaggaacaaaacaagcacattctgggcctgtgcttgttatttcaggttaatataatgcttgaagtgctgatgagagaaatactgtaagtgaaggaactaaagaaatcaccagtcaggaaagaagtcaaattatctttatttacaataaaatggttctattaaaaaaaaatcctgtaagtagcaaactgtaagaatctaccagaaaactcctacagttgataaacactcagcaaagtaacaatacaaaatgaagacacaaaactcagtagtctttctttgtacaaataataaacaaaaagacaaagaaattagggaaaccatcccagtcacaataacctcaaaaattatttgaataaatcaaactaaggaagtacaagagttgtataattaaattttaaaaaattaaagaaaatatgttgaaaaagcaaccagaaggtgaaaaaaaaccacccatgctcagaatgttgtaaaaatagtcattctacctaaaacaatttacagactcaatataatccccatcaaaatcatagcttgatttttcataaaaagaaacactaaaatttatttcataatacacatgacagaaaaacaatcctgaatagtaaaagaagtgctatcagtatcatcatctatgattttaagttatactacaaagctttagtaataaaaacagcatggtgctgacataaaaacagacacttcaagtaatgaaatcgaagtgaaaacttcttgatggtaagatcagattgctatagacaccaaccacatccttgaatcacagagcatggagacattatgctggtactcactggaaaactttatcacaactggctataatccactgtgctggcaagtgctatataaactctcttgagaataaaggcctcaatctcatccagttatgaaccctgaaggctaaaagtggcctgacaagataggattactaataattgcataggtgttttaggagtaactagccactatatgattgcattaaaggtctactctataaagtggaggccatactattaaaggagccaagaacttgtgaatagataaggtaataggccctagggtagaacccataccattactctgctaaatgcacataatattaaaatgactcctaatgattattgctatatcccgagaaaagcccattattttagctttcactagagaagctttgctccgtaacatatggcaagtaacagagatgatcctattccaaaactggtaagcatggcaagaaaaagaaagtgttaagtgctcaatcccaaatcagacatttatctcaccccaaagagctggaaagatggtcactcacaggtggtaaataacttcaaggaaacagtcttttccaagagcaagagactagatgcatatatgaacttatgacaagtcattacgataatacacccaagctacagccagccaaaaccccagcatgggggggtgggggtagagatgtcatcctaccacaagtgtcttatgaacccctggtaatctgactacacactacagcaggtcccaattccaagactagcctgacaatgcaaaactagactcaatggagaataaaggaaaaaaagtttgaaaaagtataatcttaaaataatggaagggttgagagggctgtaagaggaggagttgaggaagtgattatattcatttagagactagatgaaattttcaaatttttttaaaggaaaaaagaattttgtaaaaaaaaaaaaaaattaaacttcaacctcttgaattgttgaccagtgacatcccagtgatcactctcttccaatgctggctatttatttccatagtttttggttactctccagaacttgacagtaagacactactactgaagatataacacacttcagtaaagaaatggaaaaattaagcaaaaactcaccttgaagcttgatctctactaactaggatctgtacaacttgacaatgctatgcaaactatctgacgagaaaagtaatcaggagatattcaacttataaccaaccaatggtccttagttatatcacagttcattcccaaagtttccatatcatttctgtggtccaatagcaatcactgactccactattccacactaactatatatagtgaaagcatgacccaataactaatccttgtatcttccaaaataccaaattacagactcaataatctctaatttctcttttgttattgcttactttttttagttggtattcctctagttatttgactttgatgaaaaacttctcagatttcttctccatattagaaggctaatcttaggttaaagaaccttcaaaggttcaatctgaccaagagtatgctcaaaaaacccagaaaaatttttgaaaatagaaccacctataattagagttcagtttcacacagaaacttaaaagcatccgatcttataaccagaagtcaccctgataaaaatgttcagctctcataaaaaattctgaaaaaacattcaaggatcaacaaggcaaagtgatttgtcaaatggcatattcttaagatgttatgtattatccctcataatcacaggctgagaatatgtaatagttatttagaaataaactgctaccacaatatatttctgagacactaaatatttttcatacatttaatgatttttcactaacacttagtaagcaagcattaactcattaactaactattccttatatattttgctacgtattcaaggtagctttagttgtgaatttgatagtctaatgtgtagtgtgacctaagggactctcaattgagggactacctagattaaactggcccatgggtgtgactgggggaaaggggaaggtcttgattgatgtaagagggaccagtgtactgtggataatagcattccctaggcaggtggttttggactgtaagtaagtggtgttagcaatgcttaggtctgaaaattgagtcagcaacagtataaagttcctgccctgactactttgaacgatggcctataacatgtaagctgaaataaaccctttactcccctaagtttctttttgttagactgttaaatataaacagaacattaggttcccattctactgagaccttaaaagaaatgaagtgatactaaatctcagaaaggaaaatagtaagaattgagaagatgggacacaatcatattttgatagagatactcagaaaagatacctatgacaggcattatctaagaattctgaaacaagtaaaaaagaaaaacacgtagattaactcaagagggaacagtcagtaagttccagaactaaaacctcaaaagttgcaggttaagaacataatgctagtacaggatgtcacataaatgaaagagccagttcagggctgtatcaatttctaaccatagtttaagaaataggaaacctttgaaaagttgagtatagaaaagatggcttaacttttttttaatcagaaaagcccattgaattgttggtagtaaatagaggtaggaacaaaagtactgagaaacaatgatgtcccttatcaaaagatggcaatggtactacaaatgctttttaaagaagctgaaatgtattctgaagataaatgcaacataacttgcaaacagttccaatatgtgacacaaagagaaactaaggatgctttctagaatttggtttaaaataaagtcctactaaataagatgcaaatgtctatcagatttcaagggattgatagcatacaaataacagttctattttggatgaattgatttctggcttttttggggggtggtgtatacatgtgttgtgcacacaaacatggaggcatgcatgcccatgcatgtgcatttggagaccagaaagcaaaggcggtcataattttctaatgctcctcacacaattttttaagacgtggtctctccctaaacctgacacttgctgaattatctagactgaatgaacacatttcaaccaccattccatttctgcccctccaccaaggctgggatgaaaggccttgcctcactttttacataggttctgaaattctagtccacatagttggaaagcaggacactgagccaactctttaggccctgcttttagctgctttttgtgtttgtttgtttgtttgtttgtttgtttaaagccatgatctcatgtaactttgacttgccttactgtataggcgaagctgtccctgaataagctcccaagtaccgggagtacagaagtggagcaagcaaacatacccagccaaatatcaaaattcttaatacttctatatgcacaaattcataatatgaaattttcatataatccacctagatatcttctggttttctttcttcttctattaaactcatgggctaaaggacatcaatgtcaatgtgcatgttatatcccagtattaagagtctccaaaattatttgtatttcttaataagagaactttacaatctctttatttccaaccataactcctttatcttaagcataataaacaccatatgtaggattattaaaatgttattcgtctgttaaaaacactcactcatgcaataataattttaatatatgaagacacggctgtttttccaaagtttttattttcattgacaaataagaactacatatattatcatatgcaaaagtgatacatcaaatgagtttataaattctaacatagcacttttgcacatatacttaatagttgacttttagtgatattcaagaaaatatacagaaagaagtcaccatgctctacaattttggtcctgaactacattctattcattttgcattttttatgtctatcatttattctactctaagtaacaaacaatttttagaatgtttttacagtctatgtacaggaagatgatgcactacctgtttttgtgctgatttatttcattgaaaatataaaggatcatttccatccatgttgtcaccgacataagatttcagaaaaaaattttaatggcgaaaaattacatcatcatatatgtcaatttttatttgtttagccactgacaaacactggtttatttctgcattttgtttaattaatgctgcaatcaaaattaaactgcaggtatctcttataacacactatatatttctataatacaattgctaggtcattgcaatttttaggaacctgttattttccataatcgatctaatttacattccaaacaactgtgtacaagatttctgtttgcttacaacctcaccaacatgaacattcatatattctagcaggtaggaagtagtatctcactgttgtttcatttcttagatgattagaaaggtaaagaattttttttctcatgaatttgatgctggtcatggtggtacaacacctttaatctcacactcagaaagcagaaacaggagaatatctgagtttgaagtcagccttgtctacagagcaagttccaggacactcaggctacacagagaaaaacttgtctcaaaaaacaaaaataaataaataggtttttcctcaacacagaaaaagagcaagaattgaaatatttgagattctgcaaagaatagaggaaaagaaaaaatattataatatcaaaataatttttaaaaactcatttaaccactttgccatttgtactccttttttcccctgtctggtctataccaccttacttgtcatcctctggactgtagtccagttccacattctttcaccagcatagagcttaccaatcagattagccccatggatcctcctggatcttcctccccagcaccggaattttatgtgtacactaccacacactgcatttttatgttgttatgaaagttatcaaatcaggtccttatgcttcttaggcaagcattttacctactgagctatcttcctaccggaactacttgttcagaagcacctatttaggtcccctatccacttcttccatgagctgtctgaattacacatttcataaagtaactattcagcatgtgaatgctttcattcattccataggggggttatctgttaactatatcttttcttgtgtagaaagctattgttttgtataaccccattagtctattttttgtagttatgtttttaaaacaaaatttacaaacactaattaaaaagcttttcctgttttaatatattaggtgatacttaaaagaggatattaactaaggacacaactttgtcctatttaacatactggtttttttattctgcaagagtggtcagtgctcctaatagctgagccaccttgcagcctcaagaatgcttgagtcagagagtaaggcaatatggcccctgtagttaggcagacttgggttttgattttagctgatgttgtttcttttggggatttcaagacagtgtttcttgatgtagctttgggtgtcctagaacttcctcctgactgtctctgcctcccaagggattaaagattaaaggcatgcaacaccaccatactgggctaaaataaattccacttaattataatgaataataattatgtattgtttaattcagttggttattcctttctgaagaacttttgttactagcctatagtactagacttttgttttcatatgagagtaatgacttaacttatagtattagttcttcaaggtttagtgaatttcatcagtgatatcattaggttctgggctttatgtgacaaaagacttaattcctgatttttccatcttctgatgacacaacattctcaactctggccatcaataatagcatgcaaacttaaaatgctctaatgctaaaagtgttatacatgaaacactactaatggtttgtcctatctattctgctaatattcaatctaaaatattatctattagagactactggtacagtctaactgcaagcactatgaggtttctaaactaagcaggccattcagtgcatgaaactttcaacatttggtctgtttttttaaaacccttcatatcttggtaagttttcagtacactcaatctcaactcaattataactatagtgttccacaaaacatcattaaacctttttcaaaagaaaaagaaaaagaaaaagaaaaaggaaaagaaaaagaaaaaaaaagtacatggggagcaaagatgtggtggcacacactttaatctcagcgcttaggaggcaggggcaggccagtctctgagtttgaggccaaattggtctacagagccagtttcaggacagccagggttaaacagagaaaccctatctcgatggggagggggaaaaaaggtacatggggaaggcagttctttagtttctactatacctgcagctatctaggtatacaaaataaacgagttttcttttaaacaacaacaacaacaacaaaagttatttggctactaaactacaataaaatataacctcacatccattaggatgactattgttccccaaagaaattttaatatacgggtcaagttgtaaaaaaaaaatgtataaaacttttattctaagaaatgtaagtaaaatggtatagctattgtttaaaacagcatgatatattctcaaaatattaaaaatacaattaccatgatattctataggaccaaaagaatttgacaaaagattagacccatgctaatcacaacattattcacaattgctaaagcacagaattaacccattaacaaatgagcagaatatagcatatacaagcaagcaagtgttattcagccaaaaaaaaaaaaaaaaaaggaggaagttctagtatatgctacacataaacttcaagaacactgtgttatataaaataagccagtcatcaaaacaaaacaaaaactgtgtgactacacttacttgagatagttagaagcaccaaacccacagacaaaaagtagaatttaattgccagccacagtggaagaaacaggtcactatttaatgcatacaaagtttcagtagggcaaaatgcaaacagttctgatgacaaatgctcaaacatattaatatttacaataccactggctcatatactttagaacaataaagagtaaattttatacattttataagtgttttaaagttatcagagaagttacatggtctcaaaaatttaaaggataattcatagttgtttcttaagacttcacaatgtacttaagcatttaaagggatgtaatctgcttctagtaaggaaaacctggactttttcaaccacaccttaaacatagctatacacatctatctttacttcctcctcatttcttaagacaggaatgcatatgtgtgtgcattaacatagatggtataggtagatttatacatgtagagaggtgtgtttagaagtcagaggcttgttttcactatactcaaagcttgtcaattatgctaacctagcagccagcttgcctcttactccagtcttcttaatacttacatagcaagtgctatattcaccaagtctttgccacagtcccctgcttaattccttctagttattcctattttcatttttcattcctcattgtcaaattttgaaaaggttctcaatttcctacttttccctacactcaagtgtcttgcttcagaaccttggcaatgacttggcctagaacactgttcaaatatccaactgcttaatccccagtaacatttcaggattcaacctagttttactcagctataccaatgttcctactatgcactagatttcttttgcataatttggtactcctctgtattcccactgtataccaagtataattctatctcaataattaaaaaatctgattctgctctttctgaagcattgagatataagtctcaagcatctttatacccaaaacatagcacctgatgattaatatttagaacaggggtcatatttaaacaatcttgctttcaggaattataaattaatagcaggcacatagatgtttgaatcttcctctaattcccctatttatcaacaactgccaagggcacaaaaaacattgaaaattcagaatcatgtatgtaattatctacttaccattagacatctaattttttgcagaggtttggaagtatttggttaggagatataagtagacatgttccaatctctagatacaatttaaagttgttccttctttttctttttttaattcaattttacctttttttattttaagcctgaaaggtattttcaaataaaatagtgtagggcaacttgagacacaaaataacctgaacgaagttatacttacattcggctagcttcaatgtcctcagactgggattctcctggtgatctgtaaaatgtaattaaagacaaatattagtgatttccaaaaaaaaggtatagaaatataagtaaggaagataaactggaaaacaagacttaaattccaatgaaagggtgctttaaaagatttaaaactaagaaaaaaaaagtagaaagatcagattatcacaacacatttaagaacaaattttagaaacctcaatgtttaaaaagaaaattaaaatctttatatttagatatcaaattagtataagccataattatttacaatgtcaaacacatattaaaaaacaagactgttactttctattaagttgggttgtggtattcatagtcttgaaattaaatgaagtgtttgcaaactgtaacctgagcaaacactaaggtgtaggataatcacctttattttgaagtgatattatactgagagatttgtattcatttatacactgtctatgtattcagaaaaagcaaggataagtacttgcagaaaaaactatttccttcaaaacctaaaacattataaaaaaaaaaaatcccttgaaaaatgtctgccaatttctgcagtagacaatttaaactcaaatataacagtgttcatagatctttaagatatttaaatgctatgcaccattctaatcataattcctgtggttctataaggaaattagatttccctaaaaagcactatctgccgtcaccgtgtatatggagcattatgtttgctagataattgtaggctagttttagttttaatatctgctggttattttctttattttttaatatattagctaatatagaaatacatataaagcaccaaagagtatcccatttttattgggtggaacataagccaatttccctattctgaacatctggttaaagaacaaattccagtgatgcacacagcaatactttgctatacttcctgtcatcagaatgctaaaccaggatttagcatgaggacaggctgttctacatagtgagacactgcctcccaaaaagaaaaaaatctgttaccctacatatctttactgtgagacaatcaatgttctaaggtaaatttattttaatacctatttctaatgctttaaattcccaaaataggttaagaaagaaaagaataatttaaattttcaaatttgtatacaaagacaatctgtgaatttactactgactttagtctttcaagttaaagacttgatttgtaaatttatcactgacttcagatattcaacttaaacaaaaagtttataaaaggctggttgtggcttatggttatggaagattttttaaagcaatgattcttaagttaggggataaagaagaggctcactagttaagagcacttactgctcccagagaaatcaaggtttgcctcttagcacccacacagctgctcacaaccatcacaaactccagttccagcactgatgccctcttctggcctatgtgagtatcaggtgcacatgtgcatctggtacacacatacatacctgcaagtaaaactcacacacagaaaatttaaaaatcttagccaggcaatggtggcgcacgcctttaatcctagaagttggagggcagaggcattggatttctgagtttgaagccagtctggtctacagagtgagttccaggactacacagagagaaatccctgtcttaaaaaaacaaaaaacaacaacaaaaaatcttaaaaattaatgtattcacttctttagtgtcaaagaaatttcacttctttgcttgactttcaaaataatactcattgtaattcatttagattccaagtcagtaacacacacacaaagaaaaaggaaaaaagatacgattaaaaacagaccccaaaagctcagacagtttagattttcttagtagtttatttatatttttctgtttatcacaaaattacataagaattgaaaaatgtagattaggagtgatatcaaataaaaaattctccaccctcttcccccagaaaacaagcaaatatctcagaaataatgatctctacagccttaagaaactaccaagattgtttccaaacttatatctcatataaaatggctagaagagttaaaacatgatggtaacccatgcactagctaactcattttggaatgtgtctttccaacatctcatatattattaagactgtgagataaagctgacttgcaaaacaacaacaaaaacctgttagcaattaggaagccaaattagaagtctctaaacaggtaggaagcaaagtgttctaaatgtacaggaaaagaaaaatttagagaaggttaagaatgatgagagaaaaaatattatataagaaaatataagataagagaaaaaaagaactatatctcaagagaatattatagaactgctgcagtttcaagaccctaaaatgaactatagaacaaacatattgtcaaatggccaactacagctattttcgcaatttctgattgctacagagtatgtgaatgccagtaacataatgccaaccaagtattgtaaatatactagacttctatttaatattcacaaatattagagtaagttattaagcaccatttagccaaactaaaatttaagaaaccccagaaagatcagagtaaaattaatccaaacaaattattcttcttaaattatactcttcttgatctcttagacatagtatagcagaggctgctcccattcaaacagttttactttagtcaagagaaaaatatataaatacaacaaaagcatgtttctgatcattgtgtacatctgaatgtctatgcagacaattttaataatattctaattaagttgccaaaatatatcctaaaactagagttaactttcaaagtaactctatttttataactattagtaggtgttacaaaccacaaagtatatgtaacacctactaatagttataaaactgttctctgctcttaaaatgcttgctgctttttactgacaatacatttgaaataagaattcaggacatgctcctaattttaccaaattcaaaatatagaaccaactaaaagttaataaaaaatccactaccaacccaagactgacccaagttatcctaaagtttaccagaatattaataaaggaatgaatgaaatttgaaacctgaaaaatacctagtaacaatggtgaggaaaaagtcttttaaaagtatcaattttaggtattaactttaaagacagaaaatgtaatcacaaaacaaataatctgaacactggaacatgacctagtaaatccatccttttaaggaggtaaaggtgcacttttaactccactgtaactctctaggagaaaaagtacactcattttactaaaggtgcaacatttctggagaagcactgaaactcctgccacataaaatattaaaaataatacttaagatattttccacatatctcttaaaatgtccacactgtaatcttcaaaatacttaagacatattttcttattaatctatgcagaaaaacaggtctttgatgattacttatcttcatgaactgaagggtaagtaagaaatgcactataataaatatctgagaaaggaggttaaatgaagaaatggctccgttcttaggtcttttattcttagcaatattcctgctacctatgcatttttgtcatttttatagcacataattcatcttacaatgacagcctttctaagactgtaaaataacattcaaaattaccttttacaagctgtggccattcggtgacatcagggtgataacagctttgagtcactgattaaaaacaggttgtcacaccagtctagctgctaacttgatctgaacgtaggcttaataattctaataaattaaacaaacctttagttagaacactagcataaacccaattcattgttcaagtcattatcttcaaagctttaaatcagtagtcaatataaaattagaagaataattatcacaggaaaacctttatgaactattcttcagtatattgttttcttaaatggtctcttcatttgagaaaatgaggtatattctcaatccaaaactactccaaaatccagaatgttttaaatcatcatggcagcaaataaaaaagggctggatttaggaatatttccgattttgaattttcagactaggtatgttcaaacagtaaagtctataggaacatgccaaaatctgaaaaattcttaaatttgaaacatagtctggtcccaggcatttctgataaagataataatccctacttttcaatgtagtactatatggctcacaaaatacaacaatcaactgtacccttacattccactgactttagctctacaagatcaaaatagaagaataacaataagcagcctcagagtgattaactgacttgccgaagattttgtaaataatgttgaaattaagaccaaaaaaccaatatcagctaaatttccactaagtattagaattttgctatggtttagttttgctttacagtgttttgtaatttaaatacatacaaaaagcaaaaatttagactatgtattgtggcagtaattagaatgaaactgatttagtatcaagagtctttaactgatgggagaaatcagctaccaaacaggcaaaatcttgattaaagttttacacacacacacacacacacacacacacacacacacacgcacccacacatgaaagagagagagagagagagagacagagacagagagacagaaattatttaagtagtataatctatcattaacttttagacctttggatctataagaaagcattcgttttcaatcccactaagactcaattctaggaagtaatataaagcaaaatatgaatgaatatcctattattcacatatctgaactatcatatgtgattttaaacaaatctgattcgtttcacagccctccttatcatactatactcctgacaaaatgccaatactgttatggttttatccagttttcccccaaaatcctctttcactgatctataaacatagaacaaatttgaatgagcttaaaacaaaacaaaacaaaacaagaaagaaagaaagaaagaaagaaagaaagaaagaaagaaagaagaaaagggagtgtaagattaggaagaggaagccccttcacaattaacaccctcaaattgacagcacagacaagccagatggctgaaagcacggaatcagaacccaacttaaaacaggaagtagtgagaatcccaaaggaattattaaagcatcaatatttgaacccatattattgttagagttggctcaagtttatattatatatatatatatatatatatatatatatatatatatatatatatatataaacaaaatcagggggtcccaataaataggatttataacccctgttaagaaataacccaatttcccaaatttccctatcataactatttatcttctactaagaacagaggcatcactgaactagcaagggagagaaataacatccttgaaataaatgtggtccatggcatagttcccttagtttctcatcaaacagcttatgtggaattatgtgaatactgaaatgaatctaacttctaacttacaaacacaaagataacacagcttaaataaaatcaactaattcattaaagaactatatatactcttaggattactaaatcaagtactctccactagtctcctctttattaggttcaatgttcagttgaacagtttccaaagacattctaagattccactctccatgatcacttactatagggaaatcttggacaagttacataacctctctaaacctcaattatcttaaagcagaattaaaaccctagtctgggttatcataagagtgccttatataaaatatgtttgcaaataaatgaaagagatttttcatacccacagcctaacagccaagtctatttccttgaccttcttgttcatattactttgtctcataatacagtaaactcacaaattcttccaacaccccacttatatccctcacagtctacctggttgtatactcagcacctagtaagagtctttaaaattgacaggcgcccaaatttattgaacgcatttgtcattatactagccgtaatattaaaataattcatgcaatatgaatttcaaaaaataaaacagaaacataccatatttcgccaaacttctgaggagctggtgaactctaaaatcaggctcttagagagattttttaacctaaaatataaaacacctcactcaattcttttaacataaactggatagtctttcagaaaaaaaattactcaaattcattataaaataaaagccaatttctcttcaataatacttataaagatccaaaaatatattgaaagacaaattaccccactcctattgccaagaaaagtagcagggtagctctgtaggctgtgagctgaatattttccgactaggaaagccatgtttcccatcttcatgtacaaaaagtaatgctccacaatccctttcctcaaaccccttcagatatctacagtaagtccacttccaggtaatctctatatgaaaaacttctgctatataaaacctagagtagcaaccatggctaaatcctctgacctgtcagtctctcaagagtgctaagttgttgaattagagaaaatgtataaaaagaatatagatgctttcctgacacataacagggctctgttactcaactaagtcactccatgtctatcacaattctttacaaataaacaataacaatgtacttattacagagcttaaaacaagctctcctatgattttaaatttgtgttcatagttcatttataacttgtcttgaatatttttcagcctttaatatcttttaatcttattttgtcataaggagaaaacctaatcctatggattaagcaactacaaaataaataaatctgcatattatttataggtaaataggttggcaggtaggtgagtgagaaggaaagaaggaaaggcaaatggatgggctgataaatgatggatgggtgggtggatggacagacagattaataaattgatagatggactgatataacactatggtctccccaaagataaactttatcacatactagtaaatcctgtggcataacagtaggattctcgttccaatgactcaaatcagaaaagttcaaatcatcctgccaaatataatatattgctcactcactgctaccaattccacctcagggatctccccacaatccaacactatccctaataattctccagtggcctttacttgctttcggtatagcttaattgctccatcacaatatgtaaaactatgtttccaaaccctgctagtatacccttccttccagactagacaaaacattgagagtatgtccttaatttttatactaaatgttttaaaaggtttatagaataaaacagcacagaaaaaaaaaaaaaaagaaacttgggtagctatgtaaatgcaaggctaagaaacttcaatctgtttcaaaagactatccatgtccatttccttataaaccagtctaactcaaagtcacgccggaaaaattagctttaaaattcttttttgtaatatttcatctttaaagaaagaatccattgcttcttttccccacatggttactaagattgttgtgatacagagtcttgtcattttacctcatttctctcttacatatttgacagaactatcctcctagaaattagaatttggtcatatccctctcatattaaaaaaaaatccctatgccttctcaattctgttaacataaatttcaaacttttttttacatattaactgatgtccttgtcatatggtcacatccagtaatccaaacattacccatatatgatgacatcctgaaatatcaatctcccttggttattgtactctatcatatatcagaaatctctatttctggtcctaataattttgcttctcaggatattccacaagaaatgttttcctgtgctctgcaatttccatcctctctttatctataaaagcctatttaaaaaacaaacaaaactattcttcttaaaactttagagcaccccaaatgaacaatgacagttaaggactgagaatgacaataacactaacaatgaaaaaaatcagaaccttcacatattactaataaaagtatttcaaaggaatataaatatatagccactttgagaaaagttttaaaatgcctctagttttaaatagttgccatatttcccagacaactcacacctagatatataatcaagagaatgctatatatttacaacaaaagttaaatccatatatatgtatgtattatatattatatatctattatataatatataattatttatgtgtgtgtgtatacacacacacacacaaaataccataacaacccaaaatgaaagcatacagaagcccatatactgatgactggacagataatcagctatttaaaaaacaaacaaacaaacaaacaaacaaaaaaccaaaaaaaaaaaagaaacaaaaaaaaaaaccttgtagagtttcttttcttttaaatttttttctgtaaattataaaacacacagaaaattgcttagcatacagcaggccctggatttcaaactccagcacttaaaaaaaattaattaaaatcattaaattgaagcatgtagaaaaaaatcataaaactcttatcattttaccaaccactcagaattaaagcaaacacaaaagatgccatttgatatcattatttaaaatctaactattccaagtactggttagagatgctagaaacaaaaatgttcattcactggtgatacagtatatgttggcaaatcaaatttacataaaatttgccgtatctaatcaagttaaggatatatcctattttctaacaacttcatccctttaattttccctaaagaaaaccttttacaaaggaagtataaaaatgatctgcgcaatataggaagcaattcaaaatattcataagcagtgggatacaatactatttagttatccatatactataataccataaaagatatgtgtcaacatacacatctcaaaaacagataaaacacataaaataaaacacataaaataaagacacataaactgatggcaagtatgtatgaaacacatctataaattcttaagcatgatatctcacttattggcaaaggtcatatttaagtacaaaacagaagatattcaagaacttcaagaaatctcttacatggataagaagagagggtattaggacttggaggaagagattaagtttccaaaacaaaaatcaaaactggcatttatattccaggatggtaggtaagtagattattgatatactattaagtgctttaaatattttataacatgttttaataagaaacaatctgaatatacaatttctaagctaaaaacaaaaccctaagactatggagacttccatgacacaatcttcccaatttattaaaagtatgctaataagataaaaatgtatggctcttgagattatctccatgagtaggataaagccatataagcctgacactttaaaaaaaaaaaaaaaacactctgggattaaagttaaaaattgagagaccttaatctacctaactatcctctgacctccacccgcatcacagcatggcactcttatgtccaaatacacattatacaacacataatgataataatagtaataataattcaaaagattaagacaaaatataaaggactaaaggactagaagaaatgttccctgggtttaatgccaagaaccccccccaaaaaaaactattattataacatgataattttaagcgcagaataggtgtctaaataattaagctattatctcttgaccactaaaaagacgaattagtatcaatttttaaaagaccttcagaaggtctttgttaattgtccaggccactatagtactgcttaattctgtttacctttaaattctcaagcctagagaattatgtattaccatacatacatatttcaagagcctacagcagatatcctaacccagacctgaacaatctagaaagtagttcattcaatccaacatttacaaatacctgcatctgcagaagggaaaggaaaaggacaaaagggagagaacagtgagagaggaaagaactgggagacatgaggttagaaagagagaaaaaagagaagaggaaagatggaaaaagggagaagacaaaggatacagaatacaaaatgtgtacacaaacatttactgttctcccagactcttcagtataggaatagacatctaatttcaactggttaagttatgtgcatatatctgtttttacgttcacctcttccctgtgtttcatttaactcaaaaaaaaaaaaaaaatggagtaagagaaaatttcagaatcagtagaaagatgatccatacaaagttaaatcagaccaaaacaatctttcatttttaaagtgacatgaaacataatgtaccagccagtaattatacatgatgttaagtacagataaaagactaaaattagctcagttctcctactatgctttaagagctcttactttaaaattatatagcccaatctgtagaggaaagtatattcctcctttaagttcctaaacttgtacataacttcttattcccatctccagtctagaatcctgtacaatgttatagaatcagtgagaaacagtaacagagaggatggagaatgggacagaatttccaagcggagaaatttcatttctttgaaactaaggatttggattttcttaatgtattttctatcagtaacacatgatacagagtcaggtcacttcaaaagtgaggacaaaaacatattctctaatgagtctttatctgaaataagatttatctattattatacatactatacaacaggtactcaaaaaacaacattttaagttaccaaacaaaaacacatttagcaaaggcaaatattatctttatttttagcatattgtacgcttagcaaatatatctacacaaaggggcatagtaaatagaaatcttaagggagaaatactaataaattgaggctactctacttccccttaggatgcactaggcattatttttcttaaaaaagaaaaagaaaaagaaaaagaaaaagaaaagaaaaaaaaagaaagagggactatgcatttcatcttttcctttccaaaaaaatagcagtatgattcacatctgatactaggtaaagtgctgaaacctataatgagaagagtggtatcaactaatgaaaacaaggaatgagtttcagaaaagacaagaattcaaggaaataacaaaatataaagtttgttcaaactaaatggtacattacatggttggtttcttttaatttcttctatattgttcatatcttctatatttaactagaggtatcagcatttattttatatcacagattataaaactaaattaattatggccatggttccacaatggtatctctaagactactttttcatatcagaaagtccattagaagttttaagtgaatagccatctcttttattcaaaaaagcaaaaaaacaaacaaataaaaaaaacataggtttttgttttaaaaaaagaaaaattttatcacattaaaacactgttctgtcgggcagtggtggcccacgcctttaatccctgcacttgggaagcagaggcaggcggatttctgagtttgaggtctccctggtctacagagtgagttccaggacagccagggctatacagagaaaccctgtctcaaaaacaacaacaacaacaaaaacaaaaacaaaaaaaacaaaaaaccaccgttcagaaaagtacaacactgacagtatcttcattcatgtcatagctatgtaatttgtgtgccaaactgcttgctttaaatgtccagaagaacattctgaattgaagatatatgcattggacaccacacacacacaaaaaaaattggttcacacccatagtccccagcactggagcagtgtaatcagaaggataagtaggtgaggttatcttcaactactaagaaattgagaccagtgtggactacaagatattctgtcttttaaaaaaacatataaaacaaacaagaactaaaaagtgtctcagcacttgggccgaagaccaagaattcaagggcagtctgcactacatgtccagatacagtctatcctaggttacataccatgatttttatcaactactactactccgccgccacctccgccgccaccaccaccactgccgccacagctaccaccatccatccacgcacacacccacacacataccccatcaccattcaaactagatttctaaggctccataacatatttttttcaaagtatttttttcaacctagtgatgtagctcactgctaggtagcaaggccctgtattctatccccagctatgtaaaactaaaattgaaggattttttttaatatctgatttctgtcaaattaatgagagttgtgctatactgcttaaatgatgttgacaggtaagaaagaccaaattctgaaatgtactgagctgctgctaagagtaacaacagattacacacaaggttatgtgtaaggaaaattttatcctgctcatataaaaagttcagtacctatatactactactactactactctggtttcactcaaataaggatgccagcttcagcaagatttacataggattctccttcataagcctaatgcaatttcttcgtgaggcttctcctcagatttgctacaactgaactgcaagaataagcttaactatggtactatggcccctaaaggctaccctttcccatcattcttataactgattcacttgcaattcatttaattaaaaatcaggtcaagaagagcaaatgacaaggaattcagctttgcaaataacttatcactaacaatttcatgttaaatgtacattacttatttctaggttttacctgaagccacagaagtaataagtgcttcagaacttcagtggtttaggaaacaaaacaacctaagcttattgaaatagttatcaaatctgaaactaattcatatattgtaattgcggctgtaaaggagatatacccctgcaatcccagctctcaaaagaggtacataccagaaagaccaggaggcttagccatgttaacagaaaacaatataaccgtattccatcatcctttctcctacaaatttcctgggcaagttactttctttatacagtatctatcaatgttcaagaagtatcacatatgagcagcataatcctctgtaacaagaaggcagtaccactttaatatgattaacaaggccttagaaagataaatggcctgctcctatttagctcactctggctcaagacagatgtcaggaaagcagcaacttctgacaacatgaatattgcattctttattccatttcaataatcctaagttgttttgtttcctaaaccactgaaattctgagccatttacttattctgtggcttcaggtaaaacctaaaagtaataagtaatgtatattgaaacctctttcaaaaatcagtataaaaaatttttttcatgtatagataggcccaatacttataatctttccaaattactattcattagtttagttgttatagacaactgaaatcaagaaagtataggtaatattttgaaattaaatgaaaacaaaggaaatctgatgtgtacattaataagtcactttattaagaaggaataagtgtcatgtatttcaagcctttcatggttggaaaaagaaattgagaaaaataataatatttctacttaatacaatttatttcacatcttttatttaaaagaattaaatcctgtgctatcttataaggattatattttactaatagtataaaaatatataactccataaaagtgaattgctaattgcaaaataagtgtagctattcttccaaacaaacatctctgactcttattattgaatcagaatggtaatcattgtccaaataaatgagtcctaacaggctgagtagcatactagactaaatctatttcattttatatataccacatgtgcatgtgtactgtaaaaggatattgatgggctgcaagtaagacatgaacacatataccaaggatacaaaaaaggatacaaacagtatcctttacaattgtagctaaggggttaagggatattaagtctacagaactgccctaaaactggaggggcacagacaattaaattccataacttaacagaattatcacattaaaaaataaaatggtgttatgtgcaataaataaccaacctatcagtttccaaatgatagatattttctttttttttaacccttataacccatgtcagctcacacaattcaaaggagcctcagaaacactacctgatactgataactatttcagacatattcttctatgtgatctgaatctttgcacccccccaaaaaaaaacttcactaaaagcctaaaatcggaggtgatgaaattacaagtgtaatttttaggaggacctacattgatgaatgagagcaatgtcctaattttaaaagaccatttagtcttagctgaagcaggtggatctttgagttagaggccagcttcgactatttacctagcttcagaggctagtgagagacactgacacaagaaagggaagcggggaggggaaaaagacaaaagaaaaaagaaaggaaggggagggaaatatagggaaggctggagagatgattcaaaagttaaattaaaagcacttgttgctcttccagaggacctgggttcaatttctagagcccacatggcaattaacaactgtctatatcccagtcacagcagttccaacactctcttctcacccctacagacaccacaccaatgtggactctcatataataaaatcaaaaaaagaacaaacaaaaacaaacaaacaaaaaccctaataaacagagacagagatacagagacatagtgatactggcctgcaatcacagctcctatggaaggcggcaggactcccatttcaaggtctgagctggagtgtgtacagaggactaggaagtggtagagcagttcctagaacttgagaggccctaggttcagtccttagtcctcctaacactactcaaatttacaatgaaaattagttctgatcttaagatttctcagtgtccttgactgtgagatacattttttggagttggggggaaggggggtgttgaccagtctttggtattttataaataggccaaacagacttaaggattctggaaacatagtctgaggccagcctggtcaatacagctagctccaggacagccatggctacacaaagaaaccctgcctcccaaaaatattaattaattaattaattaaagaaaaaagttttcaattacacattctatgacatctctgattgataacttttttgagacaaggtctcgcctcttagtctaggcttgccacaatccttccttagcctctcaattgttggtttacagatgtgagacatcatgcctaacataacattgtctttatttttatcagtaagaaaaagtaactgtcaaaaccaaaactctattatcctaagcctttctgaagagaacatcaaaagacttagaggactatttttatatttttatattgtttttccgtatttgaaagtacttaaaagaccacctcttaaaactcatctccagttgcaaaaatcagaacactgatgtttttaatagctgcatataaatataatataaatccattaacagtaatattatcaataataacaaacaaacctaattagaataaatgataatataccagtaaccattcatttaaggtgttggtttttttaaaggacatttgaaaagatcatcttaagctcttgaacagaaaaaaaaatagctatggccaattaaaaagaaaatgttcataaaaattgagagaaacaattattactgcaattatttgagggaagacacaaatgtttaagaaatacaactgaataaaatttacatgtcagagacattatagatacctaatgaatgcaatgttaaaaaaaaaaaaaaaaaaacgaatcaaatagaatgagttttgtctcaggtagaaatcacatttttctaatttaaaaccataaaaagggtaaatagccggtcctggtggtatacatttttaatcgcagaaccctggagacaaagccaagaggagagttagacgtcatccagcgatataccataagaccctttctcaaaaaaaaaaaaaaaaaagggtgatggtggctatttcagggataaaaaagccacctacaaaacctgcatacaaaaggaattttctaaactcaaagttaagctcctcagttatatgaagagcaacatccaaagaagtatgtgtataccacttcacaacacaccatgcaaggtaaatattgacacaaattatttcacaacctacattctgattttgaaaacaaaactacaagtcatctcatctttattatgtgctgtatctttcttaaacgatagactgcgaattgttgaagttctcatttttattacagattctgatacatggcttttttgtaaagctaagtatttatggatttacagtcatccttacttaggcttatcagcaatacagatgcagtatccacttccttaaaagtgcagtaagcagtctatttaagaggagaatttaatactaaagcaatttctgtcatacataacaagacaaaattttccttttatctctcctcaattctaaatttacataatttaccaaaaagatatcttaagagtattaactaatctgaggtgtgtcaaaaacattcgtcgtgtctcttgtccaatagggctttgatatttagctttttaacagctgtatttcttaaagttcaggccatctttatttcaaacgcacttccctatccaaaacattttaacataatctgctgcttctcccaaaaccatgggttatacgaatatccttcacgaagtaagataatggtggataacacatcccatatactatttagttaacatttccaacagtacactagctatttaacgcaatcccaaagagattttatactgttctattttagcatgctcaaaagacataaaaaaaattgacgtaaaattgtctttagaggattcttctaaagctgataaagtcttattaaaattatactttctatttttaaggctaacgcaattatagcacattcaactctgattcttccaacaaaaagcctccgcatcaaaatggggaaaacgtccttttcattttctcaactgaaaagggggaggggagaagaggaggaggccaactgcttacaggtttgcattgaaaattaacacagcagtttctgaggaatcagtaactcacgttcaactactgaatcctaccagaagcagcacacgaataaaaccagagcgcaatccttgggcttgaggtgccgcttcatccgtcttccttccaatccacccccaataccccaacccactaagcacacatctaaatatgtcttccccaccagagcgcccctttggaggaaaaggcctgcctttcgcagcctgaagccacggctggctctccgatctctgcttagatgaggcccccgatctcgacgccctgcacgtccgccccaccccgggcccactcgggtacccgtgggtgacaaaaccctccctcctgcgtccagccagcactgacagttaaggctgcagcagccgcagccaccagggcctagtcctggcaccggcccctccagaccacgcgccccaagcactcgctcacggaggcgggtgagggcccggcgcctaccctgtcagcgcgggccggagggtgacgaggggaccggcggtacagaccagagggagcgcgccgggcaggccgcagccgcagcagcactgacctgtcctcgcccccgcgcgtgggctgcggccctcgcagctgcggccgcctcactggtccttgtcgccctcgtccaccgccgccgcccgccaccgcctcgttccctttcgctggcgccaccgccgggtctcatgcgggacccgcgcttctcctcaggaaaccgaggccgagaggccaggcgcctgggcaaccttgaagtcggcgctgaagcgctgctgtcgcgatctgtccacagtggggggcgagggcggcgagcaactccgaagagaagcagaaggaggcgccaccgtcagcgacaggtcgacggaagagaagcgtaacgaggcggtgaacagctgcgtggcccggtgcgcgagcgagagagcgagcgcaggaggggcgacgaggtgctggcaaagacgaaaggccctgtcgtctcctggagtcacccaaagaggagcgccaccatcttgggagaaatacggatctcgcgaacgcagcactggacgagaggactaggtgggcggaccgagtatcccgacag

SEQ ID NO: 4 - DNA, 19 bp, Artificial Sequence
  oligonucleotide motif
aacttcatcaatatttccc

SEQ ID NO: 5 - DNA, 18 bp, Artificial Sequence
  oligonucleotide motif
acttcatcaatatttccc

SEQ ID NO: 6 - DNA, 20 bp, Artificial Sequence
  oligonucleotide motif
caacttcatcaatatttccc

SEQ ID NO: 7 - DNA, 19 bp, Artificial Sequence
  oligonucleotide motif
caacttcatcaatatttcc

SEQ ID NO: 8 - DNA, 20 bp, Artificial Sequence
  oligonucleotide motif
ccaacttcatcaatatttcc

SEQ ID NO: 9 - DNA, 20 bp, Artificial Sequence
  oligonucleotide motif
cccaacttcatcaatatttc

SEQ ID NO: 10 - DNA, 20 bp, Artificial Sequence
  oligonucleotide motif
acccaacttcatcaatattt

SEQ ID NO: 11 - DNA, 19 bp, Artificial Sequence
  oligonucleotide motif
cccaacttcatcaatattt

SEQ ID NO: 12 - DNA, 19 bp, Artificial Sequence
  oligonucleotide motif
acccaacttcatcaatatt

SEQ ID NO: 13 - DNA, 18 bp, Artificial Sequence
  oligonucleotide motif
cccaacttcatcaatatt

SEQ ID NO: 14 - DNA, 19 bp, Artificial Sequence
  oligonucleotide motif
tacccaacttcatcaatat

SEQ ID NO: 15 - DNA, 18 bp, Artificial Sequence
  oligonucleotide motif
tacccaacttcatcaata

SEQ ID NO: 16 - DNA, 19 bp, Artificial Sequence
  oligonucleotide motif
ttacccaacttcatcaata

SEQ ID NO: 17 - DNA, 19 bp, Artificial Sequence
  oligonucleotide motif
tttacccaacttcatcaat

SEQ ID NO: 18 - DNA, 19 bp, Artificial Sequence
  oligonucleotide motif
atactttacccaacttcat

SEQ ID NO: 19 - DNA, 18 bp, Artificial Sequence
  oligonucleotide motif
tactttacccaacttcat

SEQ ID NO: 20 - DNA, 20 bp, Artificial Sequence
  oligonucleotide motif
ttatactttacccaacttca

SEQ ID NO: 21 - DNA, 16 bp, Artificial Sequence
  oligonucleotide motif
tcactgttctgacttt

SEQ ID NO: 22 - DNA, 20 bp, Artificial Sequence
  oligonucleotide motif
ttcaatctctatctcatcat

SEQ ID NO: 23 - DNA, 20 bp, Artificial Sequence
  oligonucleotide motif
cttcaatctctatctcatca

SEQ ID NO: 24 - DNA, 19 bp, Artificial Sequence
  oligonucleotide motif
ttcaatctctatctcatca

SEQ ID NO: 25 - DNA, 19 bp, Artificial Sequence
  oligonucleotide motif
cttcaatctctatctcatc

SEQ ID NO: 26 - DNA, 19 bp, Artificial Sequence
  oligonucleotide motif
acttcaatctctatctcat

SEQ ID NO: 27 - DNA, 20 bp, Artificial Sequence
  oligonucleotide motif
cacttcaatctctatctcat

SEQ ID NO: 28 - DNA, 18 bp, Artificial Sequence
  oligonucleotide motif
acttcaatctctatctca

SEQ ID NO: 29 - DNA, 19 bp, Artificial Sequence
  oligonucleotide motif
cacttcaatctctatctca

SEQ ID NO: 30 - DNA, 19 bp, Artificial Sequence
  oligonucleotide motif
acacttcaatctctatctc

SEQ ID NO: 31 - DNA, 20 bp, Artificial Sequence
  oligonucleotide motif
tacacttcaatctctatctc

SEQ ID NO: 32 - DNA, 19 bp, Artificial Sequence
  oligonucleotide motif
tacacttcaatctctatct

SEQ ID NO: 33 - DNA, 17 bp, Artificial Sequence
  oligonucleotide motif
ctttgtctctctttact

SEQ ID NO: 34 - DNA, 18 bp, Artificial Sequence
  oligonucleotide motif
tatacctttctttaaccc

SEQ ID NO: 35 - DNA, 16 bp, Artificial Sequence
  oligonucleotide motif
tgtttataccctttcc

SEQ ID NO: 36 - DNA, 16 bp, Artificial Sequence
  oligonucleotide motif
tctcctttatgactcc

SEQ ID NO: 37 - DNA, 17 bp, Artificial Sequence
  oligonucleotide motif
cttctcctttatgactc

SEQ ID NO: 38 - DNA, 19 bp, Artificial Sequence
  oligonucleotide motif
ccatttatttccatttatt

SEQ ID NO: 39 - DNA, 20 bp, Artificial Sequence
  oligonucleotide motif
ctttccatttatttccattt

SEQ ID NO: 40 - DNA, 20 bp, Artificial Sequence
  oligonucleotide motif
tctttccatttatttccatt

SEQ ID NO: 41 - DNA, 16 bp, Artificial Sequence
  oligonucleotide motif
attacccatccgttct

SEQ ID NO: 42 - DNA, 18 bp, Artificial Sequence
  oligonucleotide motif
gcattaggcacattacat

SEQ ID NO: 43 - DNA, 20 bp, Artificial Sequence
  oligonucleotide motif
attattatttaaccttccta

SEQ ID NO: 44 - DNA, 20 bp, Artificial Sequence
  oligonucleotide motif
acattattatttaaccttcc

SEQ ID NO: 45 - DNA, 19 bp, Artificial Sequence
  oligonucleotide motif
cattattatttaaccttcc

SEQ ID NO: 46 - DNA, 17 bp, Artificial Sequence
  oligonucleotide motif
cctctgcttataacttt

SEQ ID NO: 47 - DNA, 17 bp, Artificial Sequence
  oligonucleotide motif
ctactatactttcctct

SEQ ID NO: 48 - DNA, 17 bp, Artificial Sequence
  oligonucleotide motif
gttctactatactttcc

SEQ ID NO: 49 - DNA, 18 bp, Artificial Sequence
  oligonucleotide motif
cacctgataacagaccct

SEQ ID NO: 50 - DNA, 16 bp, Artificial Sequence
  oligonucleotide motif
cacctgataacagacc

SEQ ID NO: 51 - DNA, 18 bp, Artificial Sequence
  oligonucleotide motif
cccaccaaaggatatatt

SEQ ID NO: 52 - DNA, 18 bp, Artificial Sequence
  oligonucleotide motif
accagctacaggaacctc

SEQ ID NO: 53 - DNA, 19 bp, Artificial Sequence
  oligonucleotide motif
ctatatctcactcctattt

SEQ ID NO: 54 - DNA, 18 bp, Artificial Sequence
  oligonucleotide motif
ctatatctcactcctatt

SEQ ID NO: 55 - DNA, 20 bp, Artificial Sequence
  oligonucleotide motif
ctactatatctcactcctat

SEQ ID NO: 56 - DNA, 19 bp, Artificial Sequence
  oligonucleotide motif
tactatatctcactcctat

SEQ ID NO: 57 - DNA, 19 bp, Artificial Sequence
  oligonucleotide motif
ctactatatctcactccta

SEQ ID NO: 58 - DNA, 18 bp, Artificial Sequence
  oligonucleotide motif
tactatatctcactccta

SEQ ID NO: 59 - DNA, 18 bp, Artificial Sequence
  oligonucleotide motif
ctactatatctcactcct

SEQ ID NO: 60 - DNA, 17 bp, Artificial Sequence
  oligonucleotide motif
ctactatatctcactcc

SEQ ID NO: 61 - DNA, 17 bp, Artificial Sequence
  oligonucleotide motif
cctactatatctcactc

SEQ ID NO: 62 - DNA, 19 bp, Artificial Sequence
  oligonucleotide motif
ctcctactatatctcactc

SEQ ID NO: 63 - DNA, 18 bp, Artificial Sequence
  oligonucleotide motif
tcctactatatctcactc

SEQ ID NO: 64 - DNA, 18 bp, Artificial Sequence
  oligonucleotide motif
ctcctactatatctcact

SEQ ID NO: 65 - DNA, 19 bp, Artificial Sequence
  oligonucleotide motif
tttcctctcctactatatc

SEQ ID NO: 66 - DNA, 16 bp, Artificial Sequence
  oligonucleotide motif
atccatatcctttcct

SEQ ID NO: 67 - DNA, 17 bp, Artificial Sequence
  oligonucleotide motif
catccatatcctttcct

SEQ ID NO: 68 - DNA, 18 bp, Artificial Sequence
  oligonucleotide motif
atcatccatatcctttcc

SEQ ID NO: 69 - DNA, 18 bp, Artificial Sequence
  oligonucleotide motif
catcatccatatcctttc

SEQ ID NO: 70 - DNA, 20 bp, Artificial Sequence
  oligonucleotide motif
tacatcatccatatcctttc

SEQ ID NO: 71 - DNA, 18 bp, Artificial Sequence
  oligonucleotide motif
acatcatccatatccttt

SEQ ID NO: 72 - DNA, 17 bp, Artificial Sequence
  oligonucleotide motif
catcatccatatccttt

SEQ ID NO: 73 - DNA, 19 bp, Artificial Sequence
  oligonucleotide motif
tacatcatccatatccttt

SEQ ID NO: 74 - DNA, 19 bp, Artificial Sequence
  oligonucleotide motif
atacatcatccatatcctt

SEQ ID NO: 75 - DNA, 18 bp, Artificial Sequence
  oligonucleotide motif
tacatcatccatatcctt

SEQ ID NO: 76 - DNA, 20 bp, Artificial Sequence
  oligonucleotide motif
tatacatcatccatatcctt

SEQ ID NO: 77 - DNA, 18 bp, Artificial Sequence
  oligonucleotide motif
atacatcatccatatcct

SEQ ID NO: 78 - DNA, 20 bp, Artificial Sequence
  oligonucleotide motif
atatacatcatccatatcct

SEQ ID NO: 79 - DNA, 17 bp, Artificial Sequence
  oligonucleotide motif
tacatcatccatatcct

SEQ ID NO: 80 - DNA, 19 bp, Artificial Sequence
  oligonucleotide motif
tatacatcatccatatcct

SEQ ID NO: 81 - DNA, 17 bp, Artificial Sequence
  oligonucleotide motif
atacatcatccatatcc

SEQ ID NO: 82 - DNA, 19 bp, Artificial Sequence
  oligonucleotide motif
atatacatcatccatatcc

SEQ ID NO: 83 - DNA, 18 bp, Artificial Sequence
  oligonucleotide motif
tatacatcatccatatcc

SEQ ID NO: 84 - DNA, 20 bp, Artificial Sequence
  oligonucleotide motif
tatatacatcatccatatcc

SEQ ID NO: 85 - DNA, 16 bp, Artificial Sequence
  oligonucleotide motif
gcttcatatttctcca

SEQ ID NO: 86 - DNA, 17 bp, Artificial Sequence
  oligonucleotide motif
catcttgttctttacct

SEQ ID NO: 87 - DNA, 16 bp, Artificial Sequence
  oligonucleotide motif
tatattcaccattgcc

SEQ ID NO: 88 - DNA, 17 bp, Artificial Sequence
  oligonucleotide motif
ccttatattcaccattg

SEQ ID NO: 89 - DNA, 16 bp, Artificial Sequence
  oligonucleotide motif
cctccttatattcacc

SEQ ID NO: 90 - DNA, 16 bp, Artificial Sequence
  oligonucleotide motif
cccttcctttattcaa

SEQ ID NO: 91 - DNA, 17 bp, Artificial Sequence
  oligonucleotide motif
ccttactgttaaatcct

SEQ ID NO: 92 - DNA, 18 bp, Artificial Sequence
  oligonucleotide motif
caggcagataacctccaa

SEQ ID NO: 93 - DNA, 18 bp, Artificial Sequence
  oligonucleotide motif
cagcaggcagataacctc

SEQ ID NO: 94 - DNA, 18 bp, Artificial Sequence
  oligonucleotide motif
cgaatcttgacatacagg

SEQ ID NO: 95 - DNA, 17 bp, Artificial Sequence
  oligonucleotide motif
ctcatacttgctttaat

SEQ ID NO: 96 - DNA, 17 bp, Artificial Sequence
  oligonucleotide motif
acatctcatacttgctt

SEQ ID NO: 97 - DNA, 16 bp, Artificial Sequence
  oligonucleotide motif
acatctcatacttgct

SEQ ID NO: 98 - DNA, 17 bp, Artificial Sequence
  oligonucleotide motif
tacatctcatacttgct

SEQ ID NO: 99 - DNA, 18 bp, Artificial Sequence
  oligonucleotide motif
cctacatctcatacttgc

SEQ ID NO: 100 - DNA, 17 bp, Artificial Sequence
  oligonucleotide motif
ctacatctcatacttgc

SEQ ID NO: 101 - DNA, 16 bp, Artificial Sequence
  oligonucleotide motif
tacatctcatacttgc

SEQ ID NO: 102 - DNA, 17 bp, Artificial Sequence
  oligonucleotide motif
cctacatctcatacttg

SEQ ID NO: 103 - DNA, 17 bp, Artificial Sequence
  oligonucleotide motif
acctacatctcatactt

SEQ ID NO: 104 - DNA, 16 bp, Artificial Sequence
  oligonucleotide motif
cctacatctcatactt

SEQ ID NO: 105 - DNA, 18 bp, Artificial Sequence
  oligonucleotide motif
tacctacatctcatactt

SEQ ID NO: 106 - DNA, 19 bp, Artificial Sequence
  oligonucleotide motif
ttacctacatctcatactt

SEQ ID NO: 107 - DNA, 16 bp, Artificial Sequence
  oligonucleotide motif
acctacatctcatact

SEQ ID NO: 108 - DNA, 17 bp, Artificial Sequence
  oligonucleotide motif
tacctacatctcatact

SEQ ID NO: 109 - DNA, 18 bp, Artificial Sequence
  oligonucleotide motif
ttacctacatctcatact

SEQ ID NO: 110 - DNA, 17 bp, Artificial Sequence
  oligonucleotide motif
ttacctacatctcatac

SEQ ID NO: 111 - DNA, 17 bp, Artificial Sequence
  oligonucleotide motif
gttacctacatctcata

SEQ ID NO: 112 - DNA, 16 bp, Artificial Sequence
  oligonucleotide motif
gttacctacatctcat

SEQ ID NO: 113 - DNA, 18 bp, Artificial Sequence
  oligonucleotide motif
atatacccaaaggcacct

SEQ ID NO: 114 - DNA, 20 bp, Artificial Sequence
  oligonucleotide motif
tctactcatcctttaactca

SEQ ID NO: 115 - DNA, 17 bp, Artificial Sequence
  oligonucleotide motif
ccttaatctgtatcact

SEQ ID NO: 116 - DNA, 16 bp, Artificial Sequence
  oligonucleotide motif
ccatacacagcacata

SEQ ID NO: 117 - DNA, 17 bp, Artificial Sequence
  oligonucleotide motif
ctccatacacagcacat

SEQ ID NO: 118 - DNA, 17 bp, Artificial Sequence
  oligonucleotide motif
cagaataattctcctcc

SEQ ID NO: 119 - DNA, 16 bp, Artificial Sequence
  oligonucleotide motif
gtcctacatatatacc

SEQ ID NO: 120 - DNA, 16 bp, Artificial Sequence
  oligonucleotide motif
tgcttccttactaacc

SEQ ID NO: 121 - DNA, 16 bp, Artificial Sequence
  oligonucleotide motif
ccctttgtaatcatct

SEQ ID NO: 122 - DNA, 17 bp, Artificial Sequence
  oligonucleotide motif
tccctttgtaatcatct

SEQ ID NO: 123 - DNA, 16 bp, Artificial Sequence
  oligonucleotide motif
ctgccatcaataccat

SEQ ID NO: 124 - DNA, 17 bp, Artificial Sequence
  oligonucleotide motif
tcactgccatcaatacc

SEQ ID NO: 125 - DNA, 19 bp, Artificial Sequence
  oligonucleotide motif
attcttactttattcctca

SEQ ID NO: 126 - DNA, 17 bp, Artificial Sequence
  oligonucleotide motif
tcactttccagatatca

SEQ ID NO: 127 - DNA, 19 bp, Artificial Sequence
  oligonucleotide motif
tccttcaaattccacatac

SEQ ID NO: 128 - DNA, 17 bp, Artificial Sequence
  oligonucleotide motif
acatgtccctttatatt

SEQ ID NO: 129 - DNA, 16 bp, Artificial Sequence
  oligonucleotide motif
acatgtccctttatat

SEQ ID NO: 130 - DNA, 18 bp, Artificial Sequence
  oligonucleotide motif
ccaagaaaggagcaagct

SEQ ID NO: 131 - DNA, 18 bp, Artificial Sequence
  oligonucleotide motif
tccaagaaaggagcaagc

SEQ ID NO: 132 - DNA, 17 bp, Artificial Sequence
  oligonucleotide motif
ctcatccctccaagaaa

SEQ ID NO: 133 - DNA, 16 bp, Artificial Sequence
  oligonucleotide motif
tcatccctccaagaaa

SEQ ID NO: 134 - DNA, 19 bp, Artificial Sequence
  oligonucleotide motif
cacctccctattacataaa

SEQ ID NO: 135 - DNA, 18 bp, Artificial Sequence
  oligonucleotide motif
cacctccctattacataa

SEQ ID NO: 136 - DNA, 16 bp, Artificial Sequence
  oligonucleotide motif
cctccctattacataa

SEQ ID NO: 137 - DNA, 19 bp, Artificial Sequence
  oligonucleotide motif
ctaaatcttccaattcata

SEQ ID NO: 138 - DNA, 17 bp, Artificial Sequence
  oligonucleotide motif
tatcccttgattatcct

SEQ ID NO: 139 - DNA, 17 bp, Artificial Sequence
  oligonucleotide motif
cctctttgtcaaatact

SEQ ID NO: 140 - DNA, 17 bp, Artificial Sequence
  oligonucleotide motif
cagcttatttacctctt

SEQ ID NO: 141 - DNA, 19 bp, Artificial Sequence
  oligonucleotide motif
actctttacctctaacact

SEQ ID NO: 142 - DNA, 20 bp, Artificial Sequence
  oligonucleotide motif
ttactctttacctctaacac

SEQ ID NO: 143 - DNA, 19 bp, Artificial Sequence
  oligonucleotide motif
ccaacctaataccttaata

SEQ ID NO: 144 - DNA, 19 bp, Artificial Sequence
  oligonucleotide motif
taccaacctaataccttaa

SEQ ID NO: 145 - DNA, 16 bp, Artificial Sequence
  oligonucleotide motif
ccaatacccacaaacc

SEQ ID NO: 146 - DNA, 17 bp, Artificial Sequence
  oligonucleotide motif
ccattattctactttgt

SEQ ID NO: 147 - DNA, 18 bp, Artificial Sequence
  oligonucleotide motif
catttccttatcttcaca

SEQ ID NO: 148 - DNA, 19 bp, Artificial Sequence
  oligonucleotide motif
tcatttccttatcttcaca

SEQ ID NO: 149 - DNA, 18 bp, Artificial Sequence
  oligonucleotide motif
aataattcctcatttcct

SEQ ID NO: 150 - DNA, 19 bp, Artificial Sequence
  oligonucleotide motif
acaataattcctcatttcc

SEQ ID NO: 151 - DNA, 16 bp, Artificial Sequence
  oligonucleotide motif
tattgaaccaattcta

SEQ ID NO: 152 - DNA, 16 bp, Artificial Sequence
  oligonucleotide motif
catattgaaccaattc

SEQ ID NO: 153 - DNA, 16 bp, Artificial Sequence
  oligonucleotide motif
tcatattgaaccaatt

SEQ ID NO: 154 - DNA, 16 bp, Artificial Sequence
  oligonucleotide motif
catcatattgaaccaa

SEQ ID NO: 155 - DNA, 16 bp, Artificial Sequence
  oligonucleotide motif
tcatcatattgaacca

SEQ ID NO: 156 - DNA, 18 bp, Artificial Sequence
  oligonucleotide motif
cacaatcaacaacaaata

SEQ ID NO: 157 - DNA, 19 bp, Artificial Sequence
  oligonucleotide motif
tacacaatcaacaacaaat

SEQ ID NO: 158 - DNA, 16 bp, Artificial Sequence
  oligonucleotide motif
ctgtacacaatcaaca

SEQ ID NO: 159 - DNA, 17 bp, Artificial Sequence
  oligonucleotide motif
cactaataattcacttt

SEQ ID NO: 160 - DNA, 16 bp, Artificial Sequence
  oligonucleotide motif
caacattattgacact

SEQ ID NO: 161 - DNA, 18 bp, Artificial Sequence
  oligonucleotide motif
aaactttcccaacattat

SEQ ID NO: 162 - DNA, 17 bp, Artificial Sequence
  oligonucleotide motif
tcctatattctcttaaa

SEQ ID NO: 163 - DNA, 17 bp, Artificial Sequence
  oligonucleotide motif
tttcctatattctctta

SEQ ID NO: 164 - DNA, 17 bp, Artificial Sequence
  oligonucleotide motif
caagtttcctatattct

SEQ ID NO: 165 - DNA, 16 bp, Artificial Sequence
  oligonucleotide motif
caagtttcctatattc

SEQ ID NO: 166 - DNA, 16 bp, Artificial Sequence
  oligonucleotide motif
cattctatctgccaaa

SEQ ID NO: 167 - DNA, 17 bp, Artificial Sequence
  oligonucleotide motif
ccattctatctgccaaa

SEQ ID NO: 168 - DNA, 16 bp, Artificial Sequence
  oligonucleotide motif
tatagccattctatct

SEQ ID NO: 169 - DNA, 17 bp, Artificial Sequence
  oligonucleotide motif
ttatagccattctatct

SEQ ID NO: 170 - DNA, 19 bp, Artificial Sequence
  oligonucleotide motif
atttaaatttccaaacatt

SEQ ID NO: 171 - DNA, 16 bp, Artificial Sequence
  oligonucleotide motif
gctaatttaaatttcc

SEQ ID NO: 172 - DNA, 16 bp, Artificial Sequence
  oligonucleotide motif
atcaatatcttctcac

SEQ ID NO: 173 - DNA, 16 bp, Artificial Sequence
  oligonucleotide motif
tatcaatatcttctca

SEQ ID NO: 174 - DNA, 18 bp, Artificial Sequence
  oligonucleotide motif
ctacaaattcaatttact

SEQ ID NO: 175 - DNA, 18 bp, Artificial Sequence
  oligonucleotide motif
tcttactctgactttcca

SEQ ID NO: 176 - DNA, 17 bp, Artificial Sequence
  oligonucleotide motif
tcttactctgactttcc

SEQ ID NO: 177 - DNA, 17 bp, Artificial Sequence
  oligonucleotide motif
aaatttccaaacctttc

SEQ ID NO: 178 - DNA, 17 bp, Artificial Sequence
  oligonucleotide motif
cttcttgtttatcccaa

SEQ ID NO: 179 - DNA, 16 bp, Artificial Sequence
  oligonucleotide motif
ttcttgtttatcccaa

SEQ ID NO: 180 - DNA, 16 bp, Artificial Sequence
  oligonucleotide motif
atgcttctaactaaca

SEQ ID NO: 181 - DNA, 17 bp, Artificial Sequence
  oligonucleotide motif
ctttaatgcttctaact

SEQ ID NO: 182 - DNA, 17 bp, Artificial Sequence
  oligonucleotide motif
cctttaatgcttctaac

SEQ ID NO: 183 - DNA, 16 bp, Artificial Sequence
  oligonucleotide motif
ctttaatgcttctaac

SEQ ID NO: 184 - DNA, 17 bp, Artificial Sequence
  oligonucleotide motif
ttcctttaatgcttcta

SEQ ID NO: 185 - DNA, 19 bp, Artificial Sequence
  oligonucleotide motif
tatacctttctttaaccct

SEQ ID NO: 186 - DNA, 17 bp, Artificial Sequence
  oligonucleotide motif
atacctttctttaaccc

SEQ ID NO: 187 - DNA, 18 bp, Artificial Sequence
  oligonucleotide motif
ttatacctttctttaacc

SEQ ID NO: 188 - DNA, 18 bp, Artificial Sequence
  oligonucleotide motif
tttatacctttctttaac

SEQ ID NO: 189 - DNA, 17 bp, Artificial Sequence
  oligonucleotide motif
tcaagaattctctcctt

SEQ ID NO: 190 - DNA, 16 bp, Artificial Sequence
  oligonucleotide motif
ttcaagaattctctcc

SEQ ID NO: 191 - DNA, 16 bp, Artificial Sequence
  oligonucleotide motif
cttcaagaattctctc

SEQ ID NO: 192 - DNA, 16 bp, Artificial Sequence
  oligonucleotide motif
tcttcaagaattctct

SEQ ID NO: 193 - DNA, 16 bp, Artificial Sequence
  oligonucleotide motif
atcttcaagaattctc

SEQ ID NO: 194 - DNA, 16 bp, Artificial Sequence
  oligonucleotide motif
tttcttactatcttca

SEQ ID NO: 195 - DNA, 17 bp, Artificial Sequence
  oligonucleotide motif
cctttagcatttctatt

SEQ ID NO: 196 - DNA, 17 bp, Artificial Sequence
  oligonucleotide motif
tcctttagcatttctat

SEQ ID NO: 197 - DNA, 18 bp, Artificial Sequence
  oligonucleotide motif
gttctctttatttcttct

SEQ ID NO: 198 - DNA, 16 bp, Artificial Sequence
  oligonucleotide motif
tttactgtcaactcct

SEQ ID NO: 199 - DNA, 16 bp, Artificial Sequence
  oligonucleotide motif
tttccaatgaatctat

SEQ ID NO: 200 - DNA, 17 bp, Artificial Sequence
  oligonucleotide motif
cctttccaatgaatcta

SEQ ID NO: 201 - DNA, 16 bp, Artificial Sequence
  oligonucleotide motif
ctttccaatgaatcta

SEQ ID NO: 202 - DNA, 16 bp, Artificial Sequence
  oligonucleotide motif
cctttccaatgaatct

SEQ ID NO: 203 - DNA, 16 bp, Artificial Sequence
  oligonucleotide motif
ttataccctttccaat

SEQ ID NO: 204 - DNA, 17 bp, Artificial Sequence
  oligonucleotide motif
gtttataccctttccaa

SEQ ID NO: 205 - DNA, 16 bp, Artificial Sequence
  oligonucleotide motif
tttataccctttccaa

SEQ ID NO: 206 - DNA, 16 bp, Artificial Sequence
  oligonucleotide motif
gtttataccctttcca

SEQ ID NO: 207 - DNA, 17 bp, Artificial Sequence
  oligonucleotide motif
tgtttataccctttcca

SEQ ID NO: 208 - DNA, 18 bp, Artificial Sequence
  oligonucleotide motif
actgtttataccctttcc

SEQ ID NO: 209 - DNA, 17 bp, Artificial Sequence
  oligonucleotide motif
actgtttataccctttc

SEQ ID NO: 210 - DNA, 17 bp, Artificial Sequence
  oligonucleotide motif
aactgtttatacccttt

SEQ ID NO: 211 - DNA, 16 bp, Artificial Sequence
  oligonucleotide motif
tatgactccaataatc

SEQ ID NO: 212 - DNA, 17 bp, Artificial Sequence
  oligonucleotide motif
ctcctttatgactccaa

SEQ ID NO: 213 - DNA, 16 bp, Artificial Sequence
  oligonucleotide motif
ctcctttatgactcca

SEQ ID NO: 214 - DNA, 17 bp, Artificial Sequence
  oligonucleotide motif
ccattatttcttaaata

SEQ ID NO: 215 - DNA, 18 bp, Artificial Sequence
  oligonucleotide motif
atttcatattactaacta

SEQ ID NO: 216 - DNA, 18 bp, Artificial Sequence
  oligonucleotide motif
catttcatattactaact

SEQ ID NO: 217 - DNA, 18 bp, Artificial Sequence
  oligonucleotide motif
tcatttcatattactaac

SEQ ID NO: 218 - DNA, 17 bp, Artificial Sequence
  oligonucleotide motif
atcatttcatattacta

SEQ ID NO: 219 - DNA, 18 bp, Artificial Sequence
  oligonucleotide motif
ttatcatttcatattact

SEQ ID NO: 220 - DNA, 17 bp, Artificial Sequence
  oligonucleotide motif
tgtactttcctttacca

SEQ ID NO: 221 - DNA, 17 bp, Artificial Sequence
  oligonucleotide motif
tatacaccatcattata

SEQ ID NO: 222 - DNA, 17 bp, Artificial Sequence
  oligonucleotide motif
ttatacaccatcattat

SEQ ID NO: 223 - DNA, 17 bp, Artificial Sequence
  oligonucleotide motif
tatttatacaccatcat

SEQ ID NO: 224 - DNA, 16 bp, Artificial Sequence
  oligonucleotide motif
ttatttatacaccatc

SEQ ID NO: 225 - DNA, 17 bp, Artificial Sequence
  oligonucleotide motif
aattatttatacaccat

SEQ ID NO: 226 - DNA, 16 bp, Artificial Sequence
  oligonucleotide motif
catgacacttacataa

SEQ ID NO: 227 - DNA, 16 bp, Artificial Sequence
  oligonucleotide motif
agttcactactattac

SEQ ID NO: 228 - DNA, 16 bp, Artificial Sequence
  oligonucleotide motif
ataagcttacctcata

SEQ ID NO: 229 - DNA, 16 bp, Artificial Sequence
  oligonucleotide motif
tataagcttacctcat

SEQ ID NO: 230 - DNA, 16 bp, Artificial Sequence
  oligonucleotide motif
atataagcttacctca

SEQ ID NO: 231 - DNA, 17 bp, Artificial Sequence
  oligonucleotide motif
cttccctttgataacat

SEQ ID NO: 232 - DNA, 16 bp, Artificial Sequence
  oligonucleotide motif
ttccctttgataacat

SEQ ID NO: 233 - DNA, 17 bp, Artificial Sequence
  oligonucleotide motif
ccttccctttgataaca

SEQ ID NO: 234 - DNA, 16 bp, Artificial Sequence
  oligonucleotide motif
cttccctttgataaca

SEQ ID NO: 235 - DNA, 16 bp, Artificial Sequence
  oligonucleotide motif
ccttccctttgataac

SEQ ID NO: 236 - DNA, 17 bp, Artificial Sequence
  oligonucleotide motif
ttgattcaattccctta

SEQ ID NO: 237 - DNA, 17 bp, Artificial Sequence
  oligonucleotide motif
attgattcaattccctt

SEQ ID NO: 238 - DNA, 16 bp, Artificial Sequence
  oligonucleotide motif
ttgattcaattccctt

SEQ ID NO: 239 - DNA, 17 bp, Artificial Sequence
  oligonucleotide motif
tattgattcaattccct

SEQ ID NO: 240 - DNA, 16 bp, Artificial Sequence
  oligonucleotide motif
tattgattcaattccc

SEQ ID NO: 241 - DNA, 17 bp, Artificial Sequence
  oligonucleotide motif
gcacattctttctatac

SEQ ID NO: 242 - DNA, 16 bp, Artificial Sequence
  oligonucleotide motif
gaatttcaactactat

SEQ ID NO: 243 - DNA, 18 bp, Artificial Sequence
  oligonucleotide motif
ccatttatttccatttat

SEQ ID NO: 244 - DNA, 19 bp, Artificial Sequence
  oligonucleotide motif
tttccatttatttccattt

SEQ ID NO: 245 - DNA, 18 bp, Artificial Sequence
  oligonucleotide motif
ctttccatttatttccat

SEQ ID NO: 246 - DNA, 18 bp, Artificial Sequence
  oligonucleotide motif
tctttccatttatttcca

SEQ ID NO: 247 - DNA, 18 bp, Artificial Sequence
  oligonucleotide motif
atctttccatttatttcc

SEQ ID NO: 248 - DNA, 16 bp, Artificial Sequence
  oligonucleotide motif
ttccatgcaaacttta

SEQ ID NO: 249 - DNA, 16 bp, Artificial Sequence
  oligonucleotide motif
cagtttaaattcacac

SEQ ID NO: 250 - DNA, 16 bp, Artificial Sequence
  oligonucleotide motif
ctattccagtttaaat

SEQ ID NO: 251 - DNA, 16 bp, Artificial Sequence
  oligonucleotide motif
tgcaaatacctcttca

SEQ ID NO: 252 - DNA, 16 bp, Artificial Sequence
  oligonucleotide motif
ctaaatagattccact

SEQ ID NO: 253 - DNA, 16 bp, Artificial Sequence
  oligonucleotide motif
tattgatatttactct

SEQ ID NO: 254 - DNA, 16 bp, Artificial Sequence
  oligonucleotide motif
ccttagtattacaatt

SEQ ID NO: 255 - DNA, 19 bp, Artificial Sequence
  oligonucleotide motif
ctattcaataaactaaaca

SEQ ID NO: 256 - DNA, 16 bp, Artificial Sequence
  oligonucleotide motif
cagctattcaataaac

SEQ ID NO: 257 - DNA, 16 bp, Artificial Sequence
  oligonucleotide motif
tatagacccaaactat

SEQ ID NO: 258 - DNA, 17 bp, Artificial Sequence
  oligonucleotide motif
taatcccatacatctat

SEQ ID NO: 259 - DNA, 17 bp, Artificial Sequence
  oligonucleotide motif
ataatcccatacatcta

SEQ ID NO: 260 - DNA, 16 bp, Artificial Sequence
  oligonucleotide motif
atctcaactaccattt

SEQ ID NO: 261 - DNA, 16 bp, Artificial Sequence
  oligonucleotide motif
aatctcaactaccatt

SEQ ID NO: 262 - DNA, 16 bp, Artificial Sequence
  oligonucleotide motif
acaacttctatcatac

SEQ ID NO: 263 - DNA, 16 bp, Artificial Sequence
  oligonucleotide motif
gaacaacttctatcat

SEQ ID NO: 264 - DNA, 16 bp, Artificial Sequence
  oligonucleotide motif
tgaacaacttctatca

SEQ ID NO: 265 - DNA, 19 bp, Artificial Sequence
  oligonucleotide motif
tacacaaatacttaaatca

SEQ ID NO: 266 - DNA, 16 bp, Artificial Sequence
  oligonucleotide motif
ttaagctttcacctat

SEQ ID NO: 267 - DNA, 17 bp, Artificial Sequence
  oligonucleotide motif
aaactcttgcatctact

SEQ ID NO: 268 - DNA, 20 bp, Artificial Sequence
  oligonucleotide motif
aaatttctcaacctaaattt

SEQ ID NO: 269 - DNA, 16 bp, Artificial Sequence
  oligonucleotide motif
ccaacatagatcctct

SEQ ID NO: 270 - DNA, 17 bp, Artificial Sequence
  oligonucleotide motif
tccaacatagatcctct

SEQ ID NO: 271 - DNA, 17 bp, Artificial Sequence
  oligonucleotide motif
ctccaacatagatcctc

SEQ ID NO: 272 - DNA, 16 bp, Artificial Sequence
  oligonucleotide motif
tccaacatagatcctc

SEQ ID NO: 273 - DNA, 16 bp, Artificial Sequence
  oligonucleotide motif
ctccaacatagatcct

SEQ ID NO: 274 - DNA, 17 bp, Artificial Sequence
  oligonucleotide motif
tctccaacatagatcct

SEQ ID NO: 275 - DNA, 16 bp, Artificial Sequence
  oligonucleotide motif
attctcaattgcactt

SEQ ID NO: 276 - DNA, 17 bp, Artificial Sequence
  oligonucleotide motif
tattctcaattgcactt

SEQ ID NO: 277 - DNA, 16 bp, Artificial Sequence
  oligonucleotide motif
tcacctaatagcacca

SEQ ID NO: 278 - DNA, 17 bp, Artificial Sequence
  oligonucleotide motif
ttcacctaatagcacca

SEQ ID NO: 279 - DNA, 17 bp, Artificial Sequence
  oligonucleotide motif
cattattatttaacctt

SEQ ID NO: 280 - DNA, 17 bp, Artificial Sequence
  oligonucleotide motif
acattattatttaacct

SEQ ID NO: 281 - DNA, 17 bp, Artificial Sequence
  oligonucleotide motif
tacattattatttaacc

SEQ ID NO: 282 - DNA, 20 bp, Artificial Sequence
  oligonucleotide motif
catttacattattatttaac

SEQ ID NO: 283 - DNA, 18 bp, Artificial Sequence
  oligonucleotide motif
ctcatttacattattatt

SEQ ID NO: 284 - DNA, 18 bp, Artificial Sequence
  oligonucleotide motif
tatctcatttacattatt

SEQ ID NO: 285 - DNA, 17 bp, Artificial Sequence
  oligonucleotide motif
atcattctcaacaatta

SEQ ID NO: 286 - DNA, 16 bp, Artificial Sequence
  oligonucleotide motif
aagatcattctcaaca

SEQ ID NO: 287 - DNA, 17 bp, Artificial Sequence
  oligonucleotide motif
tctcaaagatcattctc

SEQ ID NO: 288 - DNA, 16 bp, Artificial Sequence
  oligonucleotide motif
tctcaaagatcattct

SEQ ID NO: 289 - DNA, 16 bp, Artificial Sequence
  oligonucleotide motif
acttaattatacttcc

SEQ ID NO: 290 - DNA, 18 bp, Artificial Sequence
  oligonucleotide motif
tacacttaattatacttc

SEQ ID NO: 291 - DNA, 18 bp, Artificial Sequence
  oligonucleotide motif
ttacacttaattatactt

SEQ ID NO: 292 - DNA, 18 bp, Artificial Sequence
  oligonucleotide motif
tttacacttaattatact

SEQ ID NO: 293 - DNA, 17 bp, Artificial Sequence
  oligonucleotide motif
ctatttaatttacactt

SEQ ID NO: 294 - DNA, 18 bp, Artificial Sequence
  oligonucleotide motif
tatctatttaatttacac

SEQ ID NO: 295 - DNA, 19 bp, Artificial Sequence
  oligonucleotide motif
tttatctatttaatttaca

SEQ ID NO: 296 - DNA, 16 bp, Artificial Sequence
  oligonucleotide motif
ctctgcttataacttt

SEQ ID NO: 297 - DNA, 16 bp, Artificial Sequence
  oligonucleotide motif
cctctgcttataactt

SEQ ID NO: 298 - DNA, 17 bp, Artificial Sequence
  oligonucleotide motif
tcctctgcttataactt

SEQ ID NO: 299 - DNA, 16 bp, Artificial Sequence
  oligonucleotide motif
tcctctgcttataact

SEQ ID NO: 300 - DNA, 17 bp, Artificial Sequence
  oligonucleotide motif
ttcctctgcttataact

SEQ ID NO: 301 - DNA, 17 bp, Artificial Sequence
  oligonucleotide motif
tttcctctgcttataac

SEQ ID NO: 302 - DNA, 16 bp, Artificial Sequence
  oligonucleotide motif
tactatactttcctct

SEQ ID NO: 303 - DNA, 16 bp, Artificial Sequence
  oligonucleotide motif
ttctactatactttcc

SEQ ID NO: 304 - DNA, 17 bp, Artificial Sequence
  oligonucleotide motif
agttctactatactttc

SEQ ID NO: 305 - DNA, 16 bp, Artificial Sequence
  oligonucleotide motif
gttctactatactttc

SEQ ID NO: 306 - DNA, 19 bp, Artificial Sequence
  oligonucleotide motif
cattatatttaaactatca

SEQ ID NO: 307 - DNA, 19 bp, Artificial Sequence
  oligonucleotide motif
cacattatatttaaactat

SEQ ID NO: 308 - DNA, 19 bp, Artificial Sequence
  oligonucleotide motif
acacattatatttaaacta

SEQ ID NO: 309 - DNA, 17 bp, Artificial Sequence
  oligonucleotide motif
accacctaagacctcaa

SEQ ID NO: 310 - DNA, 16 bp, Artificial Sequence
  oligonucleotide motif
ccacctaagacctcaa

SEQ ID NO: 311 - DNA, 16 bp, Artificial Sequence
  oligonucleotide motif
accacctaagacctca

SEQ ID NO: 312 - DNA, 16 bp, Artificial Sequence
  oligonucleotide motif
accttaagtaacattt

SEQ ID NO: 313 - DNA, 16 bp, Artificial Sequence
  oligonucleotide motif
caccttaagtaacatt

SEQ ID NO: 314 - DNA, 16 bp, Artificial Sequence
  oligonucleotide motif
ccaccttaagtaacat

SEQ ID NO: 315 - DNA, 16 bp, Artificial Sequence
  oligonucleotide motif
accaccttaagtaaca

SEQ ID NO: 316 - DNA, 16 bp, Artificial Sequence
  oligonucleotide motif
ttattaaccaccttaa

SEQ ID NO: 317 - DNA, 16 bp, Artificial Sequence
  oligonucleotide motif
cattattaaccacctt

SEQ ID NO: 318 - DNA, 16 bp, Artificial Sequence
  oligonucleotide motif
acattattaaccacct

SEQ ID NO: 319 - DNA, 17 bp, Artificial Sequence
  oligonucleotide motif
accaattatacttacaa

SEQ ID NO: 320 - DNA, 17 bp, Artificial Sequence
  oligonucleotide motif
aaccaattatacttaca

SEQ ID NO: 321 - DNA, 16 bp, Artificial Sequence
  oligonucleotide motif
caaatacagattatcc

SEQ ID NO: 322 - DNA, 17 bp, Artificial Sequence
  oligonucleotide motif
tttacattcccatcatc

SEQ ID NO: 323 - DNA, 17 bp, Artificial Sequence
  oligonucleotide motif
cacacctattatataat

SEQ ID NO: 324 - DNA, 17 bp, Artificial Sequence
  oligonucleotide motif
tcacacctattatataa

SEQ ID NO: 325 - DNA, 18 bp, Artificial Sequence
  oligonucleotide motif
cttcacacctattatata

SEQ ID NO: 326 - DNA, 18 bp, Artificial Sequence
  oligonucleotide motif
acttcacacctattatat

SEQ ID NO: 327 - DNA, 16 bp, Artificial Sequence
  oligonucleotide motif
gctcacactaattatt

SEQ ID NO: 328 - DNA, 16 bp, Artificial Sequence
  oligonucleotide motif
atgctcacactaatta

SEQ ID NO: 329 - DNA, 16 bp, Artificial Sequence
  oligonucleotide motif
aatgctcacactaatt

SEQ ID NO: 330 - DNA, 16 bp, Artificial Sequence
  oligonucleotide motif
aaactgtacacctact

SEQ ID NO: 331 - DNA, 17 bp, Artificial Sequence
  oligonucleotide motif
gtttccatctactatta

SEQ ID NO: 332 - DNA, 16 bp, Artificial Sequence
  oligonucleotide motif
tttccatctactatta

SEQ ID NO: 333 - DNA, 16 bp, Artificial Sequence
  oligonucleotide motif
tgacataaccatatac

SEQ ID NO: 334 - DNA, 16 bp, Artificial Sequence
  oligonucleotide motif
gctcccaaacaactaa

SEQ ID NO: 335 - DNA, 16 bp, Artificial Sequence
  oligonucleotide motif
cctcaatactctactt

SEQ ID NO: 336 - DNA, 17 bp, Artificial Sequence
  oligonucleotide motif
gacctcaatactctact

SEQ ID NO: 337 - DNA, 16 bp, Artificial Sequence
  oligonucleotide motif
gacctcaatactctac

SEQ ID NO: 338 - DNA, 17 bp, Artificial Sequence
  oligonucleotide motif
tactaaacatacacata

SEQ ID NO: 339 - DNA, 17 bp, Artificial Sequence
  oligonucleotide motif
ctactaaacatacacat

SEQ ID NO: 340 - DNA, 17 bp, Artificial Sequence
  oligonucleotide motif
ttctactaaacatacac

SEQ ID NO: 341 - DNA, 16 bp, Artificial Sequence
  oligonucleotide motif
taccaatagttacctt

SEQ ID NO: 342 - DNA, 17 bp, Artificial Sequence
  oligonucleotide motif
cttaccaatagttacct

SEQ ID NO: 343 - DNA, 16 bp, Artificial Sequence
  oligonucleotide motif
ttaccaatagttacct

SEQ ID NO: 344 - DNA, 16 bp, Artificial Sequence
  oligonucleotide motif
cttaccaatagttacc

SEQ ID NO: 345 - DNA, 17 bp, Artificial Sequence
  oligonucleotide motif
tcttaccaatagttacc

SEQ ID NO: 346 - DNA, 17 bp, Artificial Sequence
  oligonucleotide motif
tcaaagcacaccaccac

SEQ ID NO: 347 - DNA, 17 bp, Artificial Sequence
  oligonucleotide motif
attcaaagcacaccacc

SEQ ID NO: 348 - DNA, 16 bp, Artificial Sequence
  oligonucleotide motif
agactaatcctcttaa

SEQ ID NO: 349 - DNA, 16 bp, Artificial Sequence
  oligonucleotide motif
tagactaatcctctta

SEQ ID NO: 350 - DNA, 18 bp, Artificial Sequence
  oligonucleotide motif
cccatttctaacatttac

SEQ ID NO: 351 - DNA, 16 bp, Artificial Sequence
  oligonucleotide motif
acccatttctaacatt

SEQ ID NO: 352 - DNA, 16 bp, Artificial Sequence
  oligonucleotide motif
aacccatttctaacat

SEQ ID NO: 353 - DNA, 16 bp, Artificial Sequence
  oligonucleotide motif
cctcaacttcaccaat

SEQ ID NO: 354 - DNA, 16 bp, Artificial Sequence
  oligonucleotide motif
actgatttccttaaac

SEQ ID NO: 355 - DNA, 17 bp, Artificial Sequence
  oligonucleotide motif
cactgatttccttaaac

SEQ ID NO: 356 - DNA, 17 bp, Artificial Sequence
  oligonucleotide motif
ccactgatttccttaaa

SEQ ID NO: 357 - DNA, 16 bp, Artificial Sequence
  oligonucleotide motif
accactgatttcctta

SEQ ID NO: 358 - DNA, 16 bp, Artificial Sequence
  oligonucleotide motif
caccactgatttcctt

SEQ ID NO: 359 - DNA, 16 bp, Artificial Sequence
  oligonucleotide motif
ctctgcaatacaccaa

SEQ ID NO: 360 - DNA, 16 bp, Artificial Sequence
  oligonucleotide motif
actctgcaatacacca

SEQ ID NO: 361 - DNA, 17 bp, Artificial Sequence
  oligonucleotide motif
tactctgcaatacacca

SEQ ID NO: 362 - DNA, 16 bp, Artificial Sequence
  oligonucleotide motif
tactctgcaatacacc

SEQ ID NO: 363 - DNA, 17 bp, Artificial Sequence
  oligonucleotide motif
ttactctgcaatacacc

SEQ ID NO: 364 - DNA, 16 bp, Artificial Sequence
  oligonucleotide motif
ttactctgcaatacac

SEQ ID NO: 365 - DNA, 17 bp, Artificial Sequence
  oligonucleotide motif
tttactctgcaatacac

SEQ ID NO: 366 - DNA, 17 bp, Artificial Sequence
  oligonucleotide motif
ctttactctgcaataca

SEQ ID NO: 367 - DNA, 16 bp, Artificial Sequence
  oligonucleotide motif
tttactctgcaataca

SEQ ID NO: 368 - DNA, 17 bp, Artificial Sequence
  oligonucleotide motif
gaccacactttctacca

SEQ ID NO: 369 - DNA, 16 bp, Artificial Sequence
  oligonucleotide motif
gaccacactttctacc

SEQ ID NO: 370 - DNA, 16 bp, Artificial Sequence
  oligonucleotide motif
aagaaacacccttcca

SEQ ID NO: 371 - DNA, 17 bp, Artificial Sequence
  oligonucleotide motif
atctgctacatattctt

SEQ ID NO: 372 - DNA, 16 bp, Artificial Sequence
  oligonucleotide motif
atctgctacatattct

SEQ ID NO: 373 - DNA, 17 bp, Artificial Sequence
  oligonucleotide motif
catctgctacatattct

SEQ ID NO: 374 - DNA, 16 bp, Artificial Sequence
  oligonucleotide motif
catctgctacatattc

SEQ ID NO: 375 - DNA, 16 bp, Artificial Sequence
  oligonucleotide motif
ttcaaccctaatcact

SEQ ID NO: 376 - DNA, 16 bp, Artificial Sequence
  oligonucleotide motif
attcaaccctaatcac

SEQ ID NO: 377 - DNA, 16 bp, Artificial Sequence
  oligonucleotide motif
cattcaaccctaatca

SEQ ID NO: 378 - DNA, 17 bp, Artificial Sequence
  oligonucleotide motif
gcattcaaccctaatca

SEQ ID NO: 379 - DNA, 17 bp, Artificial Sequence
  oligonucleotide motif
agcattcaaccctaatc

SEQ ID NO: 380 - DNA, 16 bp, Artificial Sequence
  oligonucleotide motif
gcattcaaccctaatc

SEQ ID NO: 381 - DNA, 16 bp, Artificial Sequence
  oligonucleotide motif
agcattcaaccctaat

SEQ ID NO: 382 - DNA, 17 bp, Artificial Sequence
  oligonucleotide motif
cagcattcaaccctaat

SEQ ID NO: 383 - DNA, 16 bp, Artificial Sequence
  oligonucleotide motif
ttaaatccagcattca

SEQ ID NO: 384 - DNA, 16 bp, Artificial Sequence
  oligonucleotide motif
ctccatatttaaatcc

SEQ ID NO: 385 - DNA, 17 bp, Artificial Sequence
  oligonucleotide motif
gctccatatttaaatcc

SEQ ID NO: 386 - DNA, 16 bp, Artificial Sequence
  oligonucleotide motif
gctccatatttaaatc

SEQ ID NO: 387 - DNA, 16 bp, Artificial Sequence
  oligonucleotide motif
agctccatatttaaat

SEQ ID NO: 388 - DNA, 16 bp, Artificial Sequence
  oligonucleotide motif
taagctccatatttaa

SEQ ID NO: 389 - DNA, 17 bp, Artificial Sequence
  oligonucleotide motif
cctaagctccatattta

SEQ ID NO: 390 - DNA, 16 bp, Artificial Sequence
  oligonucleotide motif
ctaagctccatattta

SEQ ID NO: 391 - DNA, 16 bp, Artificial Sequence
  oligonucleotide motif
cctaagctccatattt

SEQ ID NO: 392 - DNA, 16 bp, Artificial Sequence
  oligonucleotide motif
tctaccctaaattccc

SEQ ID NO: 393 - DNA, 16 bp, Artificial Sequence
  oligonucleotide motif
cacatcttgtatacaa

SEQ ID NO: 394 - DNA, 16 bp, Artificial Sequence
  oligonucleotide motif
acacatcttgtataca

SEQ ID NO: 395 - DNA, 17 bp, Artificial Sequence
  oligonucleotide motif
ctacacatcttgtatac

SEQ ID NO: 396 - DNA, 16 bp, Artificial Sequence
  oligonucleotide motif
tacacatcttgtatac

SEQ ID NO: 397 - DNA, 16 bp, Artificial Sequence
  oligonucleotide motif
cttgactacacatctt

SEQ ID NO: 398 - DNA, 16 bp, Artificial Sequence
  oligonucleotide motif
ctctacaacagtccca

SEQ ID NO: 399 - DNA, 17 bp, Artificial Sequence
  oligonucleotide motif
tctctacaacagtccca

SEQ ID NO: 400 - DNA, 18 bp, Artificial Sequence
  oligonucleotide motif
ataacattactcttaaca

SEQ ID NO: 401 - DNA, 17 bp, Artificial Sequence
  oligonucleotide motif
tttgacattccatctcc

SEQ ID NO: 402 - DNA, 17 bp, Artificial Sequence
  oligonucleotide motif
ctttgacattccatctc

SEQ ID NO: 403 - DNA, 18 bp, Artificial Sequence
  oligonucleotide motif
tctttgacattccatctc

SEQ ID NO: 404 - DNA, 16 bp, Artificial Sequence
  oligonucleotide motif
tttgacattccatctc

SEQ ID NO: 405 - DNA, 17 bp, Artificial Sequence
  oligonucleotide motif
atctttgacattccatc

SEQ ID NO: 406 - DNA, 17 bp, Artificial Sequence
  oligonucleotide motif
tatctttgacattccat

SEQ ID NO: 407 - DNA, 17 bp, Artificial Sequence
  oligonucleotide motif
tactatctttgacattc

SEQ ID NO: 408 - DNA, 16 bp, Artificial Sequence
  oligonucleotide motif
tactatctttgacatt

SEQ ID NO: 409 - DNA, 16 bp, Artificial Sequence
  oligonucleotide motif
ctgtatacaccatccc

SEQ ID NO: 410 - DNA, 16 bp, Artificial Sequence
  oligonucleotide motif
tctgtatacaccatcc

SEQ ID NO: 411 - DNA, 17 bp, Artificial Sequence
  oligonucleotide motif
tttctgactccctatcc

SEQ ID NO: 412 - DNA, 17 bp, Artificial Sequence
  oligonucleotide motif
cctatgttaatactttc

SEQ ID NO: 413 - DNA, 16 bp, Artificial Sequence
  oligonucleotide motif
ctatgttaatactttc

SEQ ID NO: 414 - DNA, 16 bp, Artificial Sequence
  oligonucleotide motif
cctatgttaatacttt

SEQ ID NO: 415 - DNA, 16 bp, Artificial Sequence
  oligonucleotide motif
tcctatgttaatactt

SEQ ID NO: 416 - DNA, 16 bp, Artificial Sequence
  oligonucleotide motif
atcctatgttaatact

SEQ ID NO: 417 - DNA, 17 bp, Artificial Sequence
  oligonucleotide motif
atttcattaagtcaccc

SEQ ID NO: 418 - DNA, 16 bp, Artificial Sequence
  oligonucleotide motif
atttcattaagtcacc

SEQ ID NO: 419 - DNA, 17 bp, Artificial Sequence
  oligonucleotide motif
ctctcctcaagatcaac

SEQ ID NO: 420 - DNA, 16 bp, Artificial Sequence
  oligonucleotide motif
ctctcctcaagatcaa

SEQ ID NO: 421 - DNA, 16 bp, Artificial Sequence
  oligonucleotide motif
ccatacagtatataca

SEQ ID NO: 422 - DNA, 16 bp, Artificial Sequence
  oligonucleotide motif
caactattatcttctt

SEQ ID NO: 423 - DNA, 16 bp, Artificial Sequence
  oligonucleotide motif
acaactattatcttct

SEQ ID NO: 424 - DNA, 17 bp, Artificial Sequence
  oligonucleotide motif
ttgcttccaatttattt

SEQ ID NO: 425 - DNA, 17 bp, Artificial Sequence
  oligonucleotide motif
atctcatgaccacctaa

SEQ ID NO: 426 - DNA, 16 bp, Artificial Sequence
  oligonucleotide motif
tctcatgaccacctaa

SEQ ID NO: 427 - DNA, 16 bp, Artificial Sequence
  oligonucleotide motif
atctcatgaccaccta

SEQ ID NO: 428 - DNA, 17 bp, Artificial Sequence
  oligonucleotide motif
tatctcatgaccaccta

SEQ ID NO: 429 - DNA, 17 bp, Artificial Sequence
  oligonucleotide motif
tttatctcatgaccacc

SEQ ID NO: 430 - DNA, 16 bp, Artificial Sequence
  oligonucleotide motif
tttatctcatgaccac

SEQ ID NO: 431 - DNA, 16 bp, Artificial Sequence
  oligonucleotide motif
attcttaccgtcttta

SEQ ID NO: 432 - DNA, 17 bp, Artificial Sequence
  oligonucleotide motif
tattcttaccgtcttta

SEQ ID NO: 433 - DNA, 16 bp, Artificial Sequence
  oligonucleotide motif
tattcttaccgtcttt

SEQ ID NO: 434 - DNA, 17 bp, Artificial Sequence
  oligonucleotide motif
ttattcttaccgtcttt

SEQ ID NO: 435 - DNA, 16 bp, Artificial Sequence
  oligonucleotide motif
atctgatctcacacat

SEQ ID NO: 436 - DNA, 17 bp, Artificial Sequence
  oligonucleotide motif
catctgatctcacacat

SEQ ID NO: 437 - DNA, 17 bp, Artificial Sequence
  oligonucleotide motif
acttccagatttctaca

SEQ ID NO: 438 - DNA, 16 bp, Artificial Sequence
  oligonucleotide motif
tttatgtttacttcat

SEQ ID NO: 439 - DNA, 17 bp, Artificial Sequence
  oligonucleotide motif
taaagatcccatcactc

SEQ ID NO: 440 - DNA, 16 bp, Artificial Sequence
  oligonucleotide motif
taaagatcccatcact

SEQ ID NO: 441 - DNA, 17 bp, Artificial Sequence
  oligonucleotide motif
cctaaagatcccatcac

SEQ ID NO: 442 - DNA, 16 bp, Artificial Sequence
  oligonucleotide motif
atcatcagttacatca

SEQ ID NO: 443 - DNA, 17 bp, Artificial Sequence
  oligonucleotide motif
actctcactgtaacttt

SEQ ID NO: 444 - DNA, 17 bp, Artificial Sequence
  oligonucleotide motif
aactctcactgtaactt

SEQ ID NO: 445 - DNA, 16 bp, Artificial Sequence
  oligonucleotide motif
actctcactgtaactt

SEQ ID NO: 446 - DNA, 16 bp, Artificial Sequence
  oligonucleotide motif
aactctcactgtaact

SEQ ID NO: 447 - DNA, 17 bp, Artificial Sequence
  oligonucleotide motif
caactctcactgtaact

SEQ ID NO: 448 - DNA, 17 bp, Artificial Sequence
  oligonucleotide motif
cctttcattaacattta

SEQ ID NO: 449 - DNA, 18 bp, Artificial Sequence
  oligonucleotide motif
ttcctttcattaacattt

SEQ ID NO: 450 - DNA, 16 bp, Artificial Sequence
  oligonucleotide motif
taatcctattccaact

SEQ ID NO: 451 - DNA, 16 bp, Artificial Sequence
  oligonucleotide motif
ctaatcctattccaac

SEQ ID NO: 452 - DNA, 16 bp, Artificial Sequence
  oligonucleotide motif
ctctaatcctattcca

SEQ ID NO: 453 - DNA, 16 bp, Artificial Sequence
  oligonucleotide motif
tctctaatcctattcc

SEQ ID NO: 454 - DNA, 17 bp, Artificial Sequence
  oligonucleotide motif
ttgtctctaatcctatt

SEQ ID NO: 455 - DNA, 16 bp, Artificial Sequence
  oligonucleotide motif
ttgtctctaatcctat

SEQ ID NO: 456 - DNA, 16 bp, Artificial Sequence
  oligonucleotide motif
tctttaagcttcccac

SEQ ID NO: 457 - DNA, 16 bp, Artificial Sequence
  oligonucleotide motif
aaactaccctgcacaa

SEQ ID NO: 458 - DNA, 16 bp, Artificial Sequence
  oligonucleotide motif
ccatgctacataaacc

SEQ ID NO: 459 - DNA, 16 bp, Artificial Sequence
  oligonucleotide motif
tccatgctacataaac

SEQ ID NO: 460 - DNA, 16 bp, Artificial Sequence
  oligonucleotide motif
actcctaagaattaca

SEQ ID NO: 461 - DNA, 16 bp, Artificial Sequence
  oligonucleotide motif
gaaactattactccta

SEQ ID NO: 462 - DNA, 16 bp, Artificial Sequence
  oligonucleotide motif
tgaaactattactcct

SEQ ID NO: 463 - DNA, 16 bp, Artificial Sequence
  oligonucleotide motif
atgaaactattactcc

SEQ ID NO: 464 - DNA, 16 bp, Artificial Sequence
  oligonucleotide motif
aacaactcatgccaca

SEQ ID NO: 465 - DNA, 16 bp, Artificial Sequence
  oligonucleotide motif
aaatattgccaccatt

SEQ ID NO: 466 - DNA, 17 bp, Artificial Sequence
  oligonucleotide motif
gttacatattctttcac

SEQ ID NO: 467 - DNA, 16 bp, Artificial Sequence
  oligonucleotide motif
tcatacttgctttaat

SEQ ID NO: 468 - DNA, 16 bp, Artificial Sequence
  oligonucleotide motif
atcctgataattaact

SEQ ID NO: 469 - DNA, 16 bp, Artificial Sequence
  oligonucleotide motif
ccttaatctgtatcac

SEQ ID NO: 470 - DNA, 16 bp, Artificial Sequence
  oligonucleotide motif
atacacagcacatatt

SEQ ID NO: 471 - DNA, 16 bp, Artificial Sequence
  oligonucleotide motif
tcagaataattctcct

SEQ ID NO: 472 - DNA, 17 bp, Artificial Sequence
  oligonucleotide motif
tcttcagctttctaaat

SEQ ID NO: 473 - DNA, 17 bp, Artificial Sequence
  oligonucleotide motif
agtccttcctttaacca

SEQ ID NO: 474 - DNA, 17 bp, Artificial Sequence
  oligonucleotide motif
tagtccttcctttaacc

SEQ ID NO: 475 - DNA, 16 bp, Artificial Sequence
  oligonucleotide motif
tttaaccttgcttata

SEQ ID NO: 476 - DNA, 16 bp, Artificial Sequence
  oligonucleotide motif
atccctttgtaatcat

SEQ ID NO: 477 - DNA, 17 bp, Artificial Sequence
  oligonucleotide motif
cttgcatttctaattac

SEQ ID NO: 478 - DNA, 17 bp, Artificial Sequence
  oligonucleotide motif
cttgtcaaatcatttct

SEQ ID NO: 479 - DNA, 16 bp, Artificial Sequence
  oligonucleotide motif
ccatctaatgattatt

SEQ ID NO: 480 - DNA, 16 bp, Artificial Sequence
  oligonucleotide motif
tatcagttatccaata

SEQ ID NO: 481 - DNA, 16 bp, Artificial Sequence
  oligonucleotide motif
tcactgccatcaatac

SEQ ID NO: 482 - DNA, 16 bp, Artificial Sequence
  oligonucleotide motif
tgtcatctacaaatca

SEQ ID NO: 483 - DNA, 16 bp, Artificial Sequence
  oligonucleotide motif
ctctttagattcatcc

SEQ ID NO: 484 - DNA, 16 bp, Artificial Sequence
  oligonucleotide motif
actctttagattcatc

SEQ ID NO: 485 - DNA, 16 bp, Artificial Sequence
  oligonucleotide motif
caactctatgactacc

SEQ ID NO: 486 - DNA, 16 bp, Artificial Sequence
  oligonucleotide motif
acctgtaatacttctt

SEQ ID NO: 487 - DNA, 17 bp, Artificial Sequence
  oligonucleotide motif
gaattctttattcctcc

SEQ ID NO: 488 - DNA, 16 bp, Artificial Sequence
  oligonucleotide motif
atctgaatcaaacctt

SEQ ID NO: 489 - DNA, 17 bp, Artificial Sequence
  oligonucleotide motif
actttactgccataatc

SEQ ID NO: 490 - DNA, 16 bp, Artificial Sequence
  oligonucleotide motif
ttactcttagcaacct

SEQ ID NO: 491 - DNA, 17 bp, Artificial Sequence
  oligonucleotide motif
caccagtatttcttctt

SEQ ID NO: 492 - DNA, 17 bp, Artificial Sequence
  oligonucleotide motif
ttcaccagtatttcttc

SEQ ID NO: 493 - DNA, 16 bp, Artificial Sequence
  oligonucleotide motif
ccaaataagcaaactc

SEQ ID NO: 494 - DNA, 16 bp, Artificial Sequence
  oligonucleotide motif
cccaaataagcaaact

SEQ ID NO: 495 - DNA, 16 bp, Artificial Sequence
  oligonucleotide motif
gactacattctcaata

SEQ ID NO: 496 - DNA, 17 bp, Artificial Sequence
  oligonucleotide motif
ttgtcaatctttattct

SEQ ID NO: 497 - DNA, 16 bp, Artificial Sequence
  oligonucleotide motif
agcttaccaaatattc

SEQ ID NO: 498 - DNA, 16 bp, Artificial Sequence
  oligonucleotide motif
ttacacatgtatatcc

SEQ ID NO: 499 - DNA, 16 bp, Artificial Sequence
  oligonucleotide motif
atcctgttaataccat

SEQ ID NO: 500 - DNA, 16 bp, Artificial Sequence
  oligonucleotide motif
ttcttagtcacacaca

SEQ ID NO: 501 - DNA, 17 bp, Artificial Sequence
  oligonucleotide motif
ttctgtttccatttaca

SEQ ID NO: 502 - DNA, 17 bp, Artificial Sequence
  oligonucleotide motif
tctatatcaagttcctt

SEQ ID NO: 503 - DNA, 16 bp, Artificial Sequence
  oligonucleotide motif
attcagttaccaacta

SEQ ID NO: 504 - DNA, 16 bp, Artificial Sequence
  oligonucleotide motif
gcttctacttaaatat

SEQ ID NO: 505 - DNA, 16 bp, Artificial Sequence
  oligonucleotide motif
ccctcaaagtaatttc

SEQ ID NO: 506 - DNA, 16 bp, Artificial Sequence
  oligonucleotide motif
aacatgtaatttccat

SEQ ID NO: 507 - DNA, 16 bp, Artificial Sequence
  oligonucleotide motif
ccagactccaatattt

SEQ ID NO: 508 - DNA, 17 bp, Artificial Sequence
  oligonucleotide motif
cttagacttcacctttc

SEQ ID NO: 509 - DNA, 16 bp, Artificial Sequence
  oligonucleotide motif
ctgcttaattatatca

SEQ ID NO: 510 - DNA, 17 bp, Artificial Sequence
  oligonucleotide motif
aaattgtctaccttcct

SEQ ID NO: 511 - DNA, 16 bp, Artificial Sequence
  oligonucleotide motif
cacttagaatatccct

SEQ ID NO: 512 - DNA, 16 bp, Artificial Sequence
  oligonucleotide motif
atccaaagtttctttc

SEQ ID NO: 513 - DNA, 16 bp, Artificial Sequence
  oligonucleotide motif
atatttgtcacctaac

SEQ ID NO: 514 - DNA, 16 bp, Artificial Sequence
  oligonucleotide motif
ctattctcagtattat

SEQ ID NO: 515 - DNA, 16 bp, Artificial Sequence
  oligonucleotide motif
ccattcaatgatcact

SEQ ID NO: 516 - DNA, 16 bp, Artificial Sequence
  oligonucleotide motif
cactagtactcttatt

SEQ ID NO: 517 - DNA, 16 bp, Artificial Sequence
  oligonucleotide motif
gccacaacatctattt

SEQ ID NO: 518 - DNA, 16 bp, Artificial Sequence
  oligonucleotide motif
agcacatataccatca

SEQ ID NO: 519 - DNA, 17 bp, Artificial Sequence
  oligonucleotide motif
gtcatctaacttcttac

SEQ ID NO: 520 - DNA, 17 bp, Artificial Sequence
  oligonucleotide motif
tgtcatctaacttctta

SEQ ID NO: 521 - DNA, 16 bp, Artificial Sequence
  oligonucleotide motif
cccttatagttattaa

SEQ ID NO: 522 - DNA, 16 bp, Artificial Sequence
  oligonucleotide motif
tccatagaattcttca

SEQ ID NO: 523 - DNA, 16 bp, Artificial Sequence
  oligonucleotide motif
ttgattccaccattaa

SEQ ID NO: 524 - DNA, 16 bp, Artificial Sequence
  oligonucleotide motif
cagccataaactatat

SEQ ID NO: 525 - DNA, 16 bp, Artificial Sequence
  oligonucleotide motif
tatgacttattccata

SEQ ID NO: 526 - DNA, 16 bp, Artificial Sequence
  oligonucleotide motif
gttaacctatatttca

SEQ ID NO: 527 - DNA, 17 bp, Artificial Sequence
  oligonucleotide motif
tgtctattctcttcatt

SEQ ID NO: 528 - DNA, 17 bp, Artificial Sequence
  oligonucleotide motif
ttactctttgatttcat

SEQ ID NO: 529 - DNA, 16 bp, Artificial Sequence
  oligonucleotide motif
gataattccaaatccc

SEQ ID NO: 530 - DNA, 17 bp, Artificial Sequence
  oligonucleotide motif
tcttatccttgaatttc

SEQ ID NO: 531 - DNA, 17 bp, Artificial Sequence
  oligonucleotide motif
atatcccttgattatcc

SEQ ID NO: 532 - DNA, 16 bp, Artificial Sequence
  oligonucleotide motif
ttagtataccctttat

SEQ ID NO: 533 - DNA, 16 bp, Artificial Sequence
  oligonucleotide motif
ctctttgtcaaatact

SEQ ID NO: 534 - DNA, 17 bp, Artificial Sequence
  oligonucleotide motif
ccaaactgtcttctaat

SEQ ID NO: 535 - DNA, 17 bp, Artificial Sequence
  oligonucleotide motif
tccaaactgtcttctaa

SEQ ID NO: 536 - DNA, 16 bp, Artificial Sequence
  oligonucleotide motif
ccagcatattatatac

SEQ ID NO: 537 - DNA, 16 bp, Artificial Sequence
  oligonucleotide motif
tccagcatattatata

SEQ ID NO: 538 - DNA, 17 bp, Artificial Sequence
  oligonucleotide motif
tcattgaacaactcttc

SEQ ID NO: 539 - DNA, 17 bp, Artificial Sequence
  oligonucleotide motif
ctgccatctttatttat

SEQ ID NO: 540 - DNA, 17 bp, Artificial Sequence
  oligonucleotide motif
tgaaacattcttcccac

SEQ ID NO: 541 - DNA, 16 bp, Artificial Sequence
  oligonucleotide motif
tttattagattactcc

SEQ ID NO: 542 - DNA, 17 bp, Artificial Sequence
  oligonucleotide motif
ttccagcttatttacct

SEQ ID NO: 543 - DNA, 16 bp, Artificial Sequence
  oligonucleotide motif
agcatcatataaacct

SEQ ID NO: 544 - DNA, 16 bp, Artificial Sequence
  oligonucleotide motif
gtacttacacatctat

SEQ ID NO: 545 - DNA, 16 bp, Artificial Sequence
  oligonucleotide motif
tgtacttacacatcta

SEQ ID NO: 546 - DNA, 17 bp, Artificial Sequence
  oligonucleotide motif
atttctctatgtcacat

SEQ ID NO: 547 - DNA, 16 bp, Artificial Sequence
  oligonucleotide motif
caaacctacgtctctc

SEQ ID NO: 548 - DNA, 17 bp, Artificial Sequence
  oligonucleotide motif
gtatttactctttacct

SEQ ID NO: 549 - DNA, 16 bp, Artificial Sequence
  oligonucleotide motif
ctaatgcaataaccca

SEQ ID NO: 550 - DNA, 16 bp, Artificial Sequence
  oligonucleotide motif
actaatgcaataaccc

SEQ ID NO: 551 - DNA, 16 bp, Artificial Sequence
  oligonucleotide motif
agctctaaaccttcaa

SEQ ID NO: 552 - DNA, 16 bp, Artificial Sequence
  oligonucleotide motif
tatttgtcaccaaacc

SEQ ID NO: 553 - DNA, 16 bp, Artificial Sequence
  oligonucleotide motif
ctcagacatctcaata

SEQ ID NO: 554 - DNA, 17 bp, Artificial Sequence
  oligonucleotide motif
tctcagcttcttcaaat

SEQ ID NO: 555 - DNA, 16 bp, Artificial Sequence
  oligonucleotide motif
gccaatacccacaaac

SEQ ID NO: 556 - DNA, 16 bp, Artificial Sequence
  oligonucleotide motif
cctctgacaaccatta

SEQ ID NO: 557 - DNA, 16 bp, Artificial Sequence
  oligonucleotide motif
cagataactctaaacc

SEQ ID NO: 558 - DNA, 17 bp, Artificial Sequence
  oligonucleotide motif
ctaactgtttctcaatt

SEQ ID NO: 559 - DNA, 16 bp, Artificial Sequence
  oligonucleotide motif
ccaagataatcatcat

SEQ ID NO: 560 - DNA, 16 bp, Artificial Sequence
  oligonucleotide motif
tacatattgtacttct

SEQ ID NO: 561 - DNA, 16 bp, Artificial Sequence
  oligonucleotide motif
tagcctactttaatat

SEQ ID NO: 562 - DNA, 16 bp, Artificial Sequence
  oligonucleotide motif
catttacaagcacata

SEQ ID NO: 563 - DNA, 16 bp, Artificial Sequence
  oligonucleotide motif
ttattctgacacactt

SEQ ID NO: 564 - DNA, 16 bp, Artificial Sequence
  oligonucleotide motif
tacattgacacctaat

SEQ ID NO: 565 - DNA, 16 bp, Artificial Sequence
  oligonucleotide motif
tttacattgacaccta

SEQ ID NO: 566 - DNA, 16 bp, Artificial Sequence
  oligonucleotide motif
tgtatataactattcc

SEQ ID NO: 567 - DNA, 17 bp, Artificial Sequence
  oligonucleotide motif
gaatcttctaattccac

SEQ ID NO: 568 - DNA, 16 bp, Artificial Sequence
  oligonucleotide motif
tgctcactaactacac

SEQ ID NO: 569 - DNA, 17 bp, Artificial Sequence
  oligonucleotide motif
tgctaccatcattacct

SEQ ID NO: 570 - DNA, 20 bp, Artificial Sequence
  oligonucleotide motif
tttatcaatatcttctcact

SEQ ID NO: 571 - DNA, 19 bp, Artificial Sequence
  oligonucleotide motif
tttatcaatatcttctcac

SEQ ID NO: 572 - DNA, 18 bp, Artificial Sequence
  oligonucleotide motif
tttatcaatatcttctca

SEQ ID NO: 573 - DNA, 20 bp, Artificial Sequence
  oligonucleotide motif
tatacctttctttaaccctt

SEQ ID NO: 574 - DNA, 20 bp, Artificial Sequence
  oligonucleotide motif
ttatacctttctttaaccct

SEQ ID NO: 575 - DNA, 20 bp, Artificial Sequence
  oligonucleotide motif
tttatacctttctttaaccc

SEQ ID NO: 576 - DNA, 20 bp, Artificial Sequence
  oligonucleotide motif
ttttatacctttctttaacc

SEQ ID NO: 577 - DNA, 20 bp, Artificial Sequence
  oligonucleotide motif
tttttatacctttctttaac

SEQ ID NO: 578 - DNA, 20 bp, Artificial Sequence
  oligonucleotide motif
ttttttcttactatcttcaa

SEQ ID NO: 579 - DNA, 20 bp, Artificial Sequence
  oligonucleotide motif
tttttttcttactatcttca

SEQ ID NO: 580 - DNA, 20 bp, Artificial Sequence
  oligonucleotide motif
atttttttcttactatcttc

SEQ ID NO: 581 - DNA, 20 bp, Artificial Sequence
  oligonucleotide motif
aatttttttcttactatctt

SEQ ID NO: 582 - DNA, 18 bp, Artificial Sequence
  oligonucleotide motif
gtttataccctttccaat

SEQ ID NO: 583 - DNA, 18 bp, Artificial Sequence
  oligonucleotide motif
tgtttataccctttccaa

SEQ ID NO: 584 - DNA, 18 bp, Artificial Sequence
  oligonucleotide motif
ctgtttataccctttcca

SEQ ID NO: 585 - DNA, 20 bp, Artificial Sequence
  oligonucleotide motif
aattatttatacaccatcat

SEQ ID NO: 586 - DNA, 20 bp, Artificial Sequence
  oligonucleotide motif
aaattatttatacaccatca

SEQ ID NO: 587 - DNA, 20 bp, Artificial Sequence
  oligonucleotide motif
aaaattatttatacaccatc

SEQ ID NO: 588 - DNA, 20 bp, Artificial Sequence
  oligonucleotide motif
taaaattatttatacaccat

SEQ ID NO: 589 - DNA, 19 bp, Artificial Sequence
  oligonucleotide motif
taaaattatttatacacca

SEQ ID NO: 590 - DNA, 17 bp, Artificial Sequence
  oligonucleotide motif
atattgattcaattccc

SEQ ID NO: 591 - DNA, 19 bp, Artificial Sequence
  oligonucleotide motif
gcacattctttctatacct

SEQ ID NO: 592 - DNA, 18 bp, Artificial Sequence
  oligonucleotide motif
gcacattctttctatacc

SEQ ID NO: 593 - DNA, 19 bp, Artificial Sequence
  oligonucleotide motif
ttatttccatttattttca

SEQ ID NO: 594 - DNA, 20 bp, Artificial Sequence
  oligonucleotide motif
tttatttccatttattttca

SEQ ID NO: 595 - DNA, 20 bp, Artificial Sequence
  oligonucleotide motif
atttatttccatttattttc

SEQ ID NO: 596 - DNA, 19 bp, Artificial Sequence
  oligonucleotide motif
tttatttccatttattttc

SEQ ID NO: 597 - DNA, 20 bp, Artificial Sequence
  oligonucleotide motif
ccatttatttccatttattt

SEQ ID NO: 598 - DNA, 20 bp, Artificial Sequence
  oligonucleotide motif
tccatttatttccatttatt

SEQ ID NO: 599 - DNA, 19 bp, Artificial Sequence
  oligonucleotide motif
tccatttatttccatttat

SEQ ID NO: 600 - DNA, 20 bp, Artificial Sequence
  oligonucleotide motif
ttccatttatttccatttat

SEQ ID NO: 601 - DNA, 20 bp, Artificial Sequence
  oligonucleotide motif
tttccatttatttccattta

SEQ ID NO: 602 - DNA, 19 bp, Artificial Sequence
  oligonucleotide motif
ctttccatttatttccatt

SEQ ID NO: 603 - DNA, 20 bp, Artificial Sequence
  oligonucleotide motif
atctttccatttatttccat

SEQ ID NO: 604 - DNA, 19 bp, Artificial Sequence
  oligonucleotide motif
tctttccatttatttccat

SEQ ID NO: 605 - DNA, 19 bp, Artificial Sequence
  oligonucleotide motif
atctttccatttatttcca

SEQ ID NO: 606 - DNA, 20 bp, Artificial Sequence
  oligonucleotide motif
tatctttccatttatttcca

SEQ ID NO: 607 - DNA, 19 bp, Artificial Sequence
  oligonucleotide motif
tatctttccatttatttcc

SEQ ID NO: 608 - DNA, 20 bp, Artificial Sequence
  oligonucleotide motif
aaatctcaactaccattttt

SEQ ID NO: 609 - DNA, 20 bp, Artificial Sequence
  oligonucleotide motif
aaaatctcaactaccatttt

SEQ ID NO: 610 - DNA, 19 bp, Artificial Sequence
  oligonucleotide motif
aaaatctcaactaccattt

SEQ ID NO: 611 - DNA, 19 bp, Artificial Sequence
  oligonucleotide motif
gaaaatctcaactaccatt

SEQ ID NO: 612 - DNA, 19 bp, Artificial Sequence
  oligonucleotide motif
tgaaaatctcaactaccat

SEQ ID NO: 613 - DNA, 19 bp, Artificial Sequence
  oligonucleotide motif
atcattctcaacaattaaa

SEQ ID NO: 614 - DNA, 18 bp, Artificial Sequence
  oligonucleotide motif
atcattctcaacaattaa

SEQ ID NO: 615 - DNA, 19 bp, Artificial Sequence
  oligonucleotide motif
gatcattctcaacaattaa

SEQ ID NO: 616 - DNA, 19 bp, Artificial Sequence
  oligonucleotide motif
agatcattctcaacaatta

SEQ ID NO: 617 - DNA, 18 bp, Artificial Sequence
  oligonucleotide motif
gatcattctcaacaatta

SEQ ID NO: 618 - DNA, 18 bp, Artificial Sequence
  oligonucleotide motif
agatcattctcaacaatt

SEQ ID NO: 619 - DNA, 17 bp, Artificial Sequence
  oligonucleotide motif
gatcattctcaacaatt

SEQ ID NO: 620 - DNA, 18 bp, Artificial Sequence
  oligonucleotide motif
aagatcattctcaacaat

SEQ ID NO: 621 - DNA, 18 bp, Artificial Sequence
  oligonucleotide motif
aaagatcattctcaacaa

SEQ ID NO: 622 - DNA, 18 bp, Artificial Sequence
  oligonucleotide motif
caaagatcattctcaaca

SEQ ID NO: 623 - DNA, 17 bp, Artificial Sequence
  oligonucleotide motif
caaagatcattctcaac

SEQ ID NO: 624 - DNA, 17 bp, Artificial Sequence
  oligonucleotide motif
ctcaaagatcattctca

SEQ ID NO: 625 - DNA, 20 bp, Artificial Sequence
  oligonucleotide motif
tacacttaattatacttcca

SEQ ID NO: 626 - DNA, 20 bp, Artificial Sequence
  oligonucleotide motif
ttacacttaattatacttcc

SEQ ID NO: 627 - DNA, 20 bp, Artificial Sequence
  oligonucleotide motif
tttacacttaattatacttc

SEQ ID NO: 628 - DNA, 20 bp, Artificial Sequence
  oligonucleotide motif
atttacacttaattatactt

SEQ ID NO: 629 - DNA, 19 bp, Artificial Sequence
  oligonucleotide motif
ttctactatactttcctct

SEQ ID NO: 630 - DNA, 19 bp, Artificial Sequence
  oligonucleotide motif
gttctactatactttcctc

SEQ ID NO: 631 - DNA, 18 bp, Artificial Sequence
  oligonucleotide motif
gttctactatactttcct

SEQ ID NO: 632 - DNA, 18 bp, Artificial Sequence
  oligonucleotide motif
agttctactatactttcc

SEQ ID NO: 633 - DNA, 20 bp, Artificial Sequence
  oligonucleotide motif
caacattattaaccacctta

SEQ ID NO: 634 - DNA, 19 bp, Artificial Sequence
  oligonucleotide motif
caacattattaaccacctt

SEQ ID NO: 635 - DNA, 19 bp, Artificial Sequence
  oligonucleotide motif
gcaacattattaaccacct

SEQ ID NO: 636 - DNA, 19 bp, Artificial Sequence
  oligonucleotide motif
agcaacattattaaccacc

SEQ ID NO: 637 - DNA, 18 bp, Artificial Sequence
  oligonucleotide motif
agcaacattattaaccac

SEQ ID NO: 638 - DNA, 19 bp, Artificial Sequence
  oligonucleotide motif
gtttccatctactattaat

SEQ ID NO: 639 - DNA, 18 bp, Artificial Sequence
  oligonucleotide motif
gtttccatctactattaa

SEQ ID NO: 640 - DNA, 18 bp, Artificial Sequence
  oligonucleotide motif
tgtttccatctactatta

SEQ ID NO: 641 - DNA, 17 bp, Artificial Sequence
  oligonucleotide motif
actctgcaatacaccaa

SEQ ID NO: 642 - DNA, 17 bp, Artificial Sequence
  oligonucleotide motif
ctgtatacaccatccca

SEQ ID NO: 643 - DNA, 18 bp, Artificial Sequence
  oligonucleotide motif
tctgtatacaccatccca

SEQ ID NO: 644 - DNA, 17 bp, Artificial Sequence
  oligonucleotide motif
tctgtatacaccatccc

SEQ ID NO: 645 - DNA, 18 bp, Artificial Sequence
  oligonucleotide motif
ttctgtatacaccatccc

SEQ ID NO: 646 - DNA, 17 bp, Artificial Sequence
  oligonucleotide motif
ttctgtatacaccatcc

SEQ ID NO: 647 - DNA, 16 bp, Artificial Sequence
  oligonucleotide motif
agcttttaaccagagt

SEQ ID NO: 648 - DNA, 17 bp, Artificial Sequence
  oligonucleotide motif
agcttttaaccagagtg

SEQ ID NO: 649 - DNA, 18 bp, Artificial Sequence
  oligonucleotide motif
agcttttaaccagagtgg

SEQ ID NO: 650 - DNA, 19 bp, Artificial Sequence
  oligonucleotide motif
agcttttaaccagagtggc

SEQ ID NO: 651 - DNA, 20 bp, Artificial Sequence
  oligonucleotide motif
agcttttaaccagagtggca

SEQ ID NO: 652 - DNA, 17 bp, Artificial Sequence
  oligonucleotide motif
cagcttttaaccagagt

SEQ ID NO: 653 - DNA, 18 bp, Artificial Sequence
  oligonucleotide motif
cagcttttaaccagagtg

SEQ ID NO: 654 - DNA, 19 bp, Artificial Sequence
  oligonucleotide motif
cagcttttaaccagagtgg

SEQ ID NO: 655 - DNA, 20 bp, Artificial Sequence
  oligonucleotide motif
cagcttttaaccagagtggc

SEQ ID NO: 656 - DNA, 15 bp, Artificial Sequence
  oligonucleotide motif
cttttaaccagagtg

SEQ ID NO: 657 - DNA, 16 bp, Artificial Sequence
  oligonucleotide motif
cttttaaccagagtgg

SEQ ID NO: 658 - DNA, 17 bp, Artificial Sequence
  oligonucleotide motif
cttttaaccagagtggc

SEQ ID NO: 659 - DNA, 18 bp, Artificial Sequence
  oligonucleotide motif
cttttaaccagagtggca

SEQ ID NO: 660 - DNA, 19 bp, Artificial Sequence
  oligonucleotide motif
cttttaaccagagtggcat

SEQ ID NO: 661 - DNA, 20 bp, Artificial Sequence
  oligonucleotide motif
cttttaaccagagtggcatc

SEQ ID NO: 662 - DNA, 15 bp, Artificial Sequence
  oligonucleotide motif
gcttttaaccagagt

SEQ ID NO: 663 - DNA, 16 bp, Artificial Sequence
  oligonucleotide motif
gcttttaaccagagtg

SEQ ID NO: 664 - DNA, 17 bp, Artificial Sequence
  oligonucleotide motif
gcttttaaccagagtgg

SEQ ID NO: 665 - DNA, 18 bp, Artificial Sequence
  oligonucleotide motif
gcttttaaccagagtggc

SEQ ID NO: 666 - DNA, 19 bp, Artificial Sequence
  oligonucleotide motif
gcttttaaccagagtggca

SEQ ID NO: 667 - DNA, 20 bp, Artificial Sequence
  oligonucleotide motif
gcttttaaccagagtggcat

SEQ ID NO: 668 - DNA, 18 bp, Artificial Sequence
  oligonucleotide motif
tcagcttttaaccagagt

SEQ ID NO: 669 - DNA, 19 bp, Artificial Sequence
  oligonucleotide motif
tcagcttttaaccagagtg

SEQ ID NO: 670 - DNA, 20 bp, Artificial Sequence
  oligonucleotide motif
tcagcttttaaccagagtgg

SEQ ID NO: 671 - DNA, 19 bp, Artificial Sequence
  oligonucleotide motif
ttcagcttttaaccagagt

SEQ ID NO: 672 - DNA, 20 bp, Artificial Sequence
  oligonucleotide motif
ttcagcttttaaccagagtg

SEQ ID NO: 673 - DNA, 20 bp, Artificial Sequence
  oligonucleotide motif
tttcagcttttaaccagagt

SEQ ID NO: 674 - DNA, 16 bp, Artificial Sequence
  oligonucleotide motif
ttttaaccagagtggc

SEQ ID NO: 675 - DNA, 17 bp, Artificial Sequence
  oligonucleotide motif
ttttaaccagagtggca

SEQ ID NO: 676 - DNA, 18 bp, Artificial Sequence
  oligonucleotide motif
ttttaaccagagtggcat

SEQ ID NO: 677 - DNA, 19 bp, Artificial Sequence
  oligonucleotide motif
ttttaaccagagtggcatc

SEQ ID NO: 678 - DNA, 20 bp, Artificial Sequence
  oligonucleotide motif
ttttaaccagagtggcatcc

SEQ ID NO: 679 - DNA, 17 bp, Artificial Sequence
  oligonucleotide motif
atcaatatcttctcact

SEQ ID NO: 680 - DNA, 18 bp, Artificial Sequence
  oligonucleotide motif
tatcaatatcttctcact

SEQ ID NO: 681 - DNA, 17 bp, Artificial Sequence
  oligonucleotide motif
tatcaatatcttctcac

SEQ ID NO: 682 - DNA, 18 bp, Artificial Sequence
  oligonucleotide motif
ttatcaatatcttctcac

SEQ ID NO: 683 - DNA, 19 bp, Artificial Sequence
  oligonucleotide motif
ttatcaatatcttctcact

SEQ ID NO: 684 - DNA, 18 bp, Artificial Sequence
  oligonucleotide motif
acctttctttaacccttt

SEQ ID NO: 685 - DNA, 19 bp, Artificial Sequence
  oligonucleotide motif
tacctttctttaacccttt

SEQ ID NO: 686 - DNA, 17 bp, Artificial Sequence
  oligonucleotide motif
atacctttctttaaccc

SEQ ID NO: 687 - DNA, 19 bp, Artificial Sequence
  oligonucleotide motif
atacctttctttaaccctt

SEQ ID NO: 688 - DNA, 20 bp, Artificial Sequence
  oligonucleotide motif
atacctttctttaacccttt

SEQ ID NO: 689 - DNA, 18 bp, Artificial Sequence
  oligonucleotide motif
atacctttctttaaccct

SEQ ID NO: 690 - DNA, 19 bp, Artificial Sequence
  oligonucleotide motif
tatacctttctttaaccct

SEQ ID NO: 691 - DNA, 17 bp, Artificial Sequence
  oligonucleotide motif
ttatacctttctttaac

SEQ ID NO: 692 - DNA, 19 bp, Artificial Sequence
  oligonucleotide motif
ttatacctttctttaaccc

SEQ ID NO: 693 - DNA, 18 bp, Artificial Sequence
  oligonucleotide motif
ttatacctttctttaacc

SEQ ID NO: 694 - DNA, 19 bp, Artificial Sequence
  oligonucleotide motif
tttatacctttctttaacc

SEQ ID NO: 695 - DNA, 18 bp, Artificial Sequence
  oligonucleotide motif
tttatacctttctttaac

SEQ ID NO: 696 - DNA, 19 bp, Artificial Sequence
  oligonucleotide motif
ttttatacctttctttaac

SEQ ID NO: 697 - DNA, 17 bp, Artificial Sequence
  oligonucleotide motif
tgtactttcctttacca

SEQ ID NO: 698 - DNA, 17 bp, Artificial Sequence
  oligonucleotide motif
ttatacaccatcattat

SEQ ID NO: 699 - DNA, 18 bp, Artificial Sequence
  oligonucleotide motif
ttatacaccatcattata

SEQ ID NO: 700 - DNA, 18 bp, Artificial Sequence
  oligonucleotide motif
tttatacaccatcattat

SEQ ID NO: 701 - DNA, 19 bp, Artificial Sequence
  oligonucleotide motif
tttatacaccatcattata

SEQ ID NO: 702 - DNA, 19 bp, Artificial Sequence
  oligonucleotide motif
atttatacaccatcattat

SEQ ID NO: 703 - DNA, 20 bp, Artificial Sequence
  oligonucleotide motif
atttatacaccatcattata

SEQ ID NO: 704 - DNA, 19 bp, Artificial Sequence
  oligonucleotide motif
tatttatacaccatcatta

SEQ ID NO: 705 - DNA, 20 bp, Artificial Sequence
  oligonucleotide motif
tatttatacaccatcattat

SEQ ID NO: 706 - DNA, 20 bp, Artificial Sequence
  oligonucleotide motif
ttatttatacaccatcatta

SEQ ID NO: 707 - DNA, 19 bp, Artificial Sequence
  oligonucleotide motif
attatttatacaccatcat

SEQ ID NO: 708 - DNA, 18 bp, Artificial Sequence
  oligonucleotide motif
attatttatacaccatca

SEQ ID NO: 709 - DNA, 20 bp, Artificial Sequence
  oligonucleotide motif
attatttatacaccatcatt

SEQ ID NO: 710 - DNA, 17 bp, Artificial Sequence
  oligonucleotide motif
attatttatacaccatc

SEQ ID NO: 711 - DNA, 18 bp, Artificial Sequence
  oligonucleotide motif
aattatttatacaccatc

SEQ ID NO: 712 - DNA, 19 bp, Artificial Sequence
  oligonucleotide motif
aattatttatacaccatca

SEQ ID NO: 713 - DNA, 19 bp, Artificial Sequence
  oligonucleotide motif
aaattatttatacaccatc

SEQ ID NO: 714 - DNA, 18 bp, Artificial Sequence
  oligonucleotide motif
aaattatttatacaccat

SEQ ID NO: 715 - DNA, 19 bp, Artificial Sequence
  oligonucleotide motif
aaaattatttatacaccat

SEQ ID NO: 716 - DNA, 18 bp, Artificial Sequence
  oligonucleotide motif
taaaattatttatacacc

SEQ ID NO: 717 - DNA, 19 bp, Artificial Sequence
  oligonucleotide motif
gtaaaattatttatacacc

SEQ ID NO: 718 - DNA, 18 bp, Artificial Sequence
  oligonucleotide motif
gtaaaattatttatacac

SEQ ID NO: 719 - DNA, 16 bp, Artificial Sequence
  oligonucleotide motif
gagtatattacctcca

SEQ ID NO: 720 - DNA, 17 bp, Artificial Sequence
  oligonucleotide motif
cttttctataatctcac

SEQ ID NO: 721 - DNA, 18 bp, Artificial Sequence
  oligonucleotide motif
cttttctataatctcaca

SEQ ID NO: 722 - DNA, 19 bp, Artificial Sequence
  oligonucleotide motif
tcttttctataatctcaca

SEQ ID NO: 723 - DNA, 18 bp, Artificial Sequence
  oligonucleotide motif
tcttttctataatctcac

SEQ ID NO: 724 - DNA, 20 bp, Artificial Sequence
  oligonucleotide motif
atcttttctataatctcaca

SEQ ID NO: 725 - DNA, 19 bp, Artificial Sequence
  oligonucleotide motif
atcttttctataatctcac

SEQ ID NO: 726 - DNA, 18 bp, Artificial Sequence
  oligonucleotide motif
atcttttctataatctca

SEQ ID NO: 727 - DNA, 20 bp, Artificial Sequence
  oligonucleotide motif
catcttttctataatctcac

SEQ ID NO: 728 - DNA, 19 bp, Artificial Sequence
  oligonucleotide motif
catcttttctataatctca

SEQ ID NO: 729 - DNA, 20 bp, Artificial Sequence
  oligonucleotide motif
tcatcttttctataatctca

SEQ ID NO: 730 - DNA, 19 bp, Artificial Sequence
  oligonucleotide motif
tcatcttttctataatctc

SEQ ID NO: 731 - DNA, 18 bp, Artificial Sequence
  oligonucleotide motif
gtcatcttttctataatc

SEQ ID NO: 732 - DNA, 18 bp, Artificial Sequence
  oligonucleotide motif
tgtcatcttttctataat

SEQ ID NO: 733 - DNA, 17 bp, Artificial Sequence
  oligonucleotide motif
acttaattatacttcca

SEQ ID NO: 734 - DNA, 17 bp, Artificial Sequence
  oligonucleotide motif
cacttaattatacttcc

SEQ ID NO: 735 - DNA, 18 bp, Artificial Sequence
  oligonucleotide motif
cacttaattatacttcca

SEQ ID NO: 736 - DNA, 19 bp, Artificial Sequence
  oligonucleotide motif
acacttaattatacttcca

SEQ ID NO: 737 - DNA, 18 bp, Artificial Sequence
  oligonucleotide motif
acacttaattatacttcc

SEQ ID NO: 738 - DNA, 17 bp, Artificial Sequence
  oligonucleotide motif
acacttaattatacttc

SEQ ID NO: 739 - DNA, 19 bp, Artificial Sequence
  oligonucleotide motif
tacacttaattatacttcc

SEQ ID NO: 740 - DNA, 18 bp, Artificial Sequence
  oligonucleotide motif
tacacttaattatacttc

SEQ ID NO: 741 - DNA, 19 bp, Artificial Sequence
  oligonucleotide motif
ttacacttaattatacttc

SEQ ID NO: 742 - DNA, 18 bp, Artificial Sequence
  oligonucleotide motif
ttacacttaattatactt

SEQ ID NO: 743 - DNA, 19 bp, Artificial Sequence
  oligonucleotide motif
tttacacttaattatactt

SEQ ID NO: 744 - DNA, 18 bp, Artificial Sequence
  oligonucleotide motif
tttacacttaattatact

SEQ ID NO: 745 - DNA, 19 bp, Artificial Sequence
  oligonucleotide motif
atttacacttaattatact

SEQ ID NO: 746 - DNA, 18 bp, Artificial Sequence
  oligonucleotide motif
atttacacttaattatac

SEQ ID NO: 747 - DNA, 19 bp, Artificial Sequence
  oligonucleotide motif
aatttacacttaattatac

SEQ ID NO: 748 - DNA, 20 bp, Artificial Sequence
  oligonucleotide motif
aatttacacttaattatact

SEQ ID NO: 749 - DNA, 20 bp, Artificial Sequence
  oligonucleotide motif
taatttacacttaattatac

SEQ ID NO: 750 - DNA, 18 bp, Artificial Sequence
  oligonucleotide motif
taatttacacttaattat

SEQ ID NO: 751 - DNA, 19 bp, Artificial Sequence
  oligonucleotide motif
taatttacacttaattata

SEQ ID NO: 752 - DNA, 20 bp, Artificial Sequence
  oligonucleotide motif
ttaatttacacttaattata

SEQ ID NO: 753 - DNA, 19 bp, Artificial Sequence
  oligonucleotide motif
ttaatttacacttaattat

SEQ ID NO: 754 - DNA, 19 bp, Artificial Sequence
  oligonucleotide motif
tttaatttacacttaatta

SEQ ID NO: 755 - DNA, 20 bp, Artificial Sequence
  oligonucleotide motif
tttaatttacacttaattat

SEQ ID NO: 756 - DNA, 20 bp, Artificial Sequence
  oligonucleotide motif
atttaatttacacttaatta

SEQ ID NO: 757 - DNA, 19 bp, Artificial Sequence
  oligonucleotide motif
atttaatttacacttaatt

SEQ ID NO: 758 - DNA, 19 bp, Artificial Sequence
  oligonucleotide motif
tatttaatttacacttaat

SEQ ID NO: 759 - DNA, 20 bp, Artificial Sequence
  oligonucleotide motif
tatttaatttacacttaatt

SEQ ID NO: 760 - DNA, 17 bp, Artificial Sequence
  oligonucleotide motif
ctatttaatttacactt

SEQ ID NO: 761 - DNA, 19 bp, Artificial Sequence
  oligonucleotide motif
ctatttaatttacacttaa

SEQ ID NO: 762 - DNA, 18 bp, Artificial Sequence
  oligonucleotide motif
ctatttaatttacactta

SEQ ID NO: 763 - DNA, 20 bp, Artificial Sequence
  oligonucleotide motif
ctatttaatttacacttaat

SEQ ID NO: 764 - DNA, 19 bp, Artificial Sequence
  oligonucleotide motif
tctatttaatttacactta

SEQ ID NO: 765 - DNA, 18 bp, Artificial Sequence
  oligonucleotide motif
tctatttaatttacactt

SEQ ID NO: 766 - DNA, 20 bp, Artificial Sequence
  oligonucleotide motif
tctatttaatttacacttaa

SEQ ID NO: 767 - DNA, 19 bp, Artificial Sequence
  oligonucleotide motif
atctatttaatttacactt

SEQ ID NO: 768 - DNA, 20 bp, Artificial Sequence
  oligonucleotide motif
atctatttaatttacactta

SEQ ID NO: 769 - DNA, 20 bp, Artificial Sequence
  oligonucleotide motif
tatctatttaatttacactt

SEQ ID NO: 770 - DNA, 19 bp, Artificial Sequence
  oligonucleotide motif
tatctatttaatttacact

SEQ ID NO: 771 - DNA, 20 bp, Artificial Sequence
  oligonucleotide motif
ttatctatttaatttacact

SEQ ID NO: 772 - DNA, 19 bp, Artificial Sequence
  oligonucleotide motif
tttatctatttaatttaca

SEQ ID NO: 773 - DNA, 19 bp, Artificial Sequence
  oligonucleotide motif
ttttatctatttaatttac

SEQ ID NO: 774 - DNA, 20 bp, Artificial Sequence
  oligonucleotide motif
ttttatctatttaatttaca

SEQ ID NO: 775 - DNA, 19 bp, Artificial Sequence
  oligonucleotide motif
cttttatctatttaattta

SEQ ID NO: 776 - DNA, 20 bp, Artificial Sequence
  oligonucleotide motif
cttttatctatttaatttac

SEQ ID NO: 777 - DNA, 19 bp, Artificial Sequence
  oligonucleotide motif
acttttatctatttaattt

SEQ ID NO: 778 - DNA, 20 bp, Artificial Sequence
  oligonucleotide motif
acttttatctatttaattta

SEQ ID NO: 779 - DNA, 18 bp, Artificial Sequence
  oligonucleotide motif
acttttatctatttaatt

SEQ ID NO: 780 - DNA, 19 bp, Artificial Sequence
  oligonucleotide motif
aacttttatctatttaatt

SEQ ID NO: 781 - DNA, 18 bp, Artificial Sequence
  oligonucleotide motif
aacttttatctatttaat

SEQ ID NO: 782 - DNA, 20 bp, Artificial Sequence
  oligonucleotide motif
aacttttatctatttaattt

SEQ ID NO: 783 - DNA, 19 bp, Artificial Sequence
  oligonucleotide motif
taacttttatctatttaat

SEQ ID NO: 784 - DNA, 20 bp, Artificial Sequence
  oligonucleotide motif
taacttttatctatttaatt

SEQ ID NO: 785 - DNA, 18 bp, Artificial Sequence
  oligonucleotide motif
taacttttatctatttaa

SEQ ID NO: 786 - DNA, 19 bp, Artificial Sequence
  oligonucleotide motif
ataacttttatctatttaa

SEQ ID NO: 787 - DNA, 20 bp, Artificial Sequence
  oligonucleotide motif
ataacttttatctatttaat

SEQ ID NO: 788 - DNA, 19 bp, Artificial Sequence
  oligonucleotide motif
tataacttttatctattta

SEQ ID NO: 789 - DNA, 20 bp, Artificial Sequence
  oligonucleotide motif
tataacttttatctatttaa

SEQ ID NO: 790 - DNA, 19 bp, Artificial Sequence
  oligonucleotide motif
ttataacttttatctattt

SEQ ID NO: 791 - DNA, 18 bp, Artificial Sequence
  oligonucleotide motif
ttataacttttatctatt

SEQ ID NO: 792 - DNA, 20 bp, Artificial Sequence
  oligonucleotide motif
ttataacttttatctattta

SEQ ID NO: 793 - DNA, 19 bp, Artificial Sequence
  oligonucleotide motif
cttataacttttatctatt

SEQ ID NO: 794 - DNA, 18 bp, Artificial Sequence
  oligonucleotide motif
cttataacttttatctat

SEQ ID NO: 795 - DNA, 20 bp, Artificial Sequence
  oligonucleotide motif
cttataacttttatctattt

SEQ ID NO: 796 - DNA, 17 bp, Artificial Sequence
  oligonucleotide motif
cttataacttttatcta

SEQ ID NO: 797 - DNA, 18 bp, Artificial Sequence
  oligonucleotide motif
gcttataacttttatcta

SEQ ID NO: 798 - DNA, 17 bp, Artificial Sequence
  oligonucleotide motif
gcttataacttttatct

SEQ ID NO: 799 - DNA, 17 bp, Artificial Sequence
  oligonucleotide motif
tgcttataacttttatc

SEQ ID NO: 800 - DNA, 18 bp, Artificial Sequence
  oligonucleotide motif
tgcttataacttttatct

SEQ ID NO: 801 - DNA, 18 bp, Artificial Sequence
  oligonucleotide motif
ctgcttataacttttatc

SEQ ID NO: 802 - DNA, 17 bp, Artificial Sequence
  oligonucleotide motif
ctctgcttataactttt

SEQ ID NO: 803 - DNA, 17 bp, Artificial Sequence
  oligonucleotide motif
cctctgcttataacttt

SEQ ID NO: 804 - DNA, 17 bp, Artificial Sequence
  oligonucleotide motif
ctactatactttcctct

SEQ ID NO: 805 - DNA, 18 bp, Artificial Sequence
  oligonucleotide motif
tctactatactttcctct

SEQ ID NO: 806 - DNA, 17 bp, Artificial Sequence
  oligonucleotide motif
ttctactatactttcct

SEQ ID NO: 807 - DNA, 18 bp, Artificial Sequence
  oligonucleotide motif
ttctactatactttcctc

SEQ ID NO: 808 - DNA, 18 bp, Artificial Sequence
  oligonucleotide motif
tttccatctactattaat

SEQ ID NO: 809 - DNA, 17 bp, Artificial Sequence
  oligonucleotide motif
tttccatctactattaa

SEQ ID NO: 810 - DNA, 17 bp, Artificial Sequence
  oligonucleotide motif
gtttccatctactatta

SEQ ID NO: 811 - DNA, 18 bp, Artificial Sequence
  oligonucleotide motif
aatacaaaatcatcttac

SEQ ID NO: 812 - DNA, 19 bp, Artificial Sequence
  oligonucleotide motif
aatacaaaatcatcttaca

SEQ ID NO: 813 - DNA, 18 bp, Artificial Sequence
  oligonucleotide motif
taatacaaaatcatctta

SEQ ID NO: 814 - DNA, 19 bp, Artificial Sequence
  oligonucleotide motif
taatacaaaatcatcttac

SEQ ID NO: 815 - DNA, 20 bp, Artificial Sequence
  oligonucleotide motif
taatacaaaatcatcttaca

SEQ ID NO: 816 - DNA, 18 bp, Artificial Sequence
  oligonucleotide motif
tctgtatacaccatccca

SEQ ID NO: 817 - DNA, 17 bp, Artificial Sequence
  oligonucleotide motif
ttctgactccctatcca

SEQ ID NO: 818 - DNA, 17 bp, Artificial Sequence
  oligonucleotide motif
tttctgactccctatcc

SEQ ID NO: 819 - DNA, 15 bp, Artificial sequence
  Control oligonucleotide
  beta-oxy-LNA nucloside (1)..(3)
  phosphorothiate Internucleoside linkages (1)..(15)
  beta-oxy-LNA nucloside (13)..(15)
cgaaccactgaacaa

SEQ ID NO: 820 - DNA, 16 bp, Artificial sequence
  Control oligonucleotide
  beta-oxy-LNA nucloside (1)..(3)
  phosphorothiate Internucleoside linkages (1)..(16)
  beta-oxy-LNA nucloside (14)..(16)
cgaaccactgaacaaa

SEQ ID NO: 821 - DNA, 13 bp, Artificial sequence
  Control oligonucleotide
  beta-oxy-LNA nucloside (1)..(3)
  phosphorothiate Internucleoside linkages (1)..(13)
  beta-oxy-LNA nucloside (12)..(13)
cgaagtgcacacg

SEQ ID NO: 822 - DNA, 14 bp, Artificial sequence
  Control oligonucleotide
  beta-oxy-LNA nucloside (1)..(3)
  phosphorothiate Internucleoside linkages (1)..(14)
  beta-oxy-LNA nucloside (12)..(14)
gcgtaaagagaggt

SEQ ID NO: 823 - DNA, 16 bp, Artificial sequence
  Control oligonucleotide
  beta-oxy-LNA nucloside (1)..(4)
  phosphorothiate Internucleoside linkages (1)..(16)
  beta-oxy-LNA nucloside (14)..(16)
gagaaggcacagacgg

SEQ ID NO: 824 - DNA, 15 bp, Artificial sequence
  Control oligonucleotide
  beta-oxy-LNA nucloside (1)..(3)
  phosphorothiate Internucleoside linkages (1)..(15)
  beta-oxy-LNA nucloside (13)..(15)
gcgaagtgcacacgg

SEQ ID NO: 825 - DNA, 16 bp, Artificial sequence
  Control oligonucleotide
  beta-oxy-LNA nucloside (1)..(3)
  phosphorothiate Internucleoside linkages (1)..(6)
  beta-oxy-LNA nucloside (14)..(16)
gagaaggcacagacgg

SEQ ID NO: 826 - DNA, 14 bp, Artificial sequence
  control oligonucleotide
  beta-oxy-LNA nucloside (1)..(3)
  phosphorothiate Internucleoside linkages (1)..(4)
  beta-oxy-LNA nucloside (11)..(14)
cgaaccactgaaca

SEQ ID NO: 827 - DNA, 15 bp, Artificial sequence
  Control oligonucleotide
  beta-oxy-LNA nucloside (1)..(3)
  phosphorothiate Internucleoside linkages (1)..(15)
  beta-oxy-LNA nucloside (13)..(15)
gaaccactgaacaaa

SEQ ID NO: 828 - DNA, 15 bp, Artificial sequence
  Control oligonucleotide
  phosphorothiate Internucleoside linkages (1)..(15)
  beta-oxy-LNA nucloside (3)..(5)
  beta-oxy-LNA nucloside (14)..(15)
cagcgtaaagagagg

SEQ ID NO: 829 - DNA, 13 bp, Artificial sequence
  Control oligonucleotide
  beta-oxy-LNA nucloside (1)..(2)
  phosphorothiate Internucleoside linkages (1)..(13)
  beta-oxy-LNA nucloside (11)..(13)
gcgtaaagagagg

SEQ ID NO: 830 - DNA, 13 bp, Artificial sequence
  Control oligonucleotide
  beta-oxy-LNA nucloside (1)..(3)
  phosphorothiate Internucleoside linkages (1)..(13)
  beta-oxy-LNA nucloside (12)..(13)
cgaaccactgaac

SEQ ID NO: 831 - DNA, 16 bp, Artificial sequence
  Control oligonucleotide
  beta-oxy-LNA nucloside (1)..(4)
  phosphorothiate Internucleoside linkages (1)..(16)
  beta-oxy-LNA nucloside (13)..(16)
cgaaccactgaacaaa

SEQ ID NO: 832 - DNA, 16 bp, Artificial sequence
  Control oligonucleotide
  beta-oxy-LNA nucloside (1)..(3)
  phosphorothiate Internucleoside linkages (1)..(16)
  beta-oxy-LNA nucloside (14)..(16)
agcgaagtgcacacgg

SEQ ID NO: 833 - DNA, 15 bp, Artificial sequence
  Control oligonucleotide
  beta-oxy-LNA nucloside (1)..(3)
  phosphorothiate Internucleoside linkages (1)..(15)
  beta-oxy-LNA nucloside (12)..(15)
aggtgaagcgaagtg

SEQ ID NO: 834 - DNA, 15 bp, Artificial sequence
  Control oligonucleotide
  beta-oxy-LNA nucloside (1)..(4)
  phosphorothiate Internucleoside linkages (1)..(15)
  beta-oxy-LNA nucloside (13)..(15)
tagtaaactgagcca

SEQ ID NO: 835 - DNA, 15 bp, Artificial sequence
  Control oligonucleotide
  beta-oxy-LNA nucloside (1)..(3)
  phosphorothiate Internucleoside linkages (1)..(15)
  beta-oxy-LNA nucloside (13)..(15)
agaaggcacagacgg

SEQ ID NO: 836 - DNA, 15 bp, Artificial sequence
  Control oligonucleotide
  beta-oxy-LNA nucloside (1)..(3)
  phosphorothiate Internucleoside linkages (1)..(15)
  beta-oxy-LNA nucloside (13)..(15)
ccgcagtatggatcg

SEQ ID NO: 837 - DNA, 20 bp, Artificial sequence
  Primer
atatgtggaagccggaatct

SEQ ID NO: 838 - DNA, 22 bp, Artificial sequence
  primer
tcccagaactccctaatcagaa

SEQ ID NO: 839 - DNA, 20 bp, Artificial sequence
  primer
atgacggtggctataccagg

SEQ ID NO: 840 - DNA, 22 bp, Artificial sequence
  Primer
gggtcaatgatgagaaccttat

SEQ ID NO: 841 - DNA, 21 bp, Artificial sequence
  Primer
gggcctcagcgtaatcctatt

SEQ ID NO: 842 - DNA, 26 bp, Artificial sequence
  Primer
ttctgaagagaggtgatgacttaaaa

SEQ ID NO: 843 - DNA, 20 bp, Artificial sequence
  Primer
atccgaggcatgaatctcac

SEQ ID NO: 844 - DNA, 20 bp, Artificial sequence
  Primer
caggccaaaacccttgataa

SEQ ID NO: 845 - DNA, 20 bp, Artificial sequence
  Primer
ttgctgagcatttttgcatc

SEQ ID NO: 846 - DNA, 16 bp, Artificial sequence
  negative control oligonucleotide
  beta-oxy-LNA nucleoside (1)..(3)
  phosphorothiate Internucleoside linkages (1)..(16)
  beta-oxy-LNA nucleoside (14)..(16)
ttgaataagtggatgt

The invention claimed is:

1. An antisense oligonucleotide which comprises a contiguous nucleotide sequence of 10 to 30 nucleotides in length with at least 98% complementarity to position 30654-30745 of SEQ ID NO: 1, wherein the oligonucleotide comprises one or more modified oligonucleotides.

2. The oligonucleotide of claim 1, wherein the oligonucleotide comprises a sequence selected from the group consisting of SEQ ID NO: 46, 47, 48, 289, 290, 291, 292, 293, 294, 295, 296, 297, 298, 299, 300, 301, 302, 303, 304, 304, 305, 625, 626, 627, 628, 629, 630, 631, 632, 733, 734, 735, 736, 737, 738, 739, 740, 741, 742, 743, 744, 745, 746, 747, 748, 749, 750, 751, 752, 754, 755, 756, 757, 758, 759, 760, 761, 762, 763, 764, 765, 766, 767, 768, 769, 770, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, and 807.

3. The oligonucleotide of claim 1 or claim 2, wherein the one or more modified nucleosides is a 2' sugar modified nucleoside.

4. The oligonucleotide of claim 3, wherein the one or more 2' sugar modified nucleoside is independently selected from the group consisting of 2'-O-alkyl-RNA, 2'-O-methyl-RNA, 2'-alkoxy-RNA, 2'-O-methoxyethyl-RNA, 2'-amino-DNA, 2'-fluoro-DNA, arabino nucleic acid (ANA), 2'-fluoro-ANA and LNA nucleosides.

5. The oligonucleotide of claim 1 or claim 2, wherein the one or more modified nucleoside is a LNA nucleoside.

6. The oligonucleotide of claim 1, wherein the oligonucleotide comprises at least one modified internucleoside linkage.

7. The oligonucleotide of claim 6, wherein the internucleoside linkages within the contiguous nucleotide sequence are phosphorothioate internucleoside linkages.

8. The oligonucleotide of claim 1, wherein the oligonucleotide is capable of recruiting RNase H.

9. The oligonucleotide of any of claims 1, 2, 7 and 8, wherein the oligonucleotide is a gapmer.

10. The oligonucleotide of claim 8, wherein the oligonucleotide is a gapmer of formula 5'-F-G-F'-3', where region F and F' independently comprise 1-7 modified nucleosides and G is a region between 6 and 16 nucleosides which are capable of recruiting RNaseH.

11. The oligonucleotide of claim 1, wherein the oligonucleotide is selected from the group consisting of CMP ID NO: 46_1, 47_1, 48_1, 48_2, 48_3, 48_4, 48_5, 48_6, 48_7, 289_1, 290_1, 291_1, 292_1, 293_1, 294_1, 295_1, 296_1, 297_1, 298_1, 299_1, 300_1, 301_1, 302_1, 303_1, 304_1, 304_2, 304_3, 304_4, 304_5, 304_6, 304_7, 304_8, 304_9, 304_11, 304_12, 304_13, 304_14, 304_15, 305_1, 625_1, 625_2, 625_3, 625_4, 625_5, 625_6, 625_7, 625_8, 625_9, 625_10, 625_11, 625_12, 625_13, 625_14, 626_1, 626_2, 626_3, 626_4, 626_5, 626_6, 626_7, 626_8, 626_9, 626_10, 626_11, 626_12, 626_13, 626_14, 626_15, 627_1, 627_2, 627_3, 627_4, 627_5, 627_6, 627_7, 627_8, 627_9, 627_10, 627_11, 627_12, 627_13, 627_14, 628_1, 628_2, 628_3, 628_4, 628_5, 628_6, 628_7, 628_8, 628_9, 628_10, 628_11, 628_12, 628_13, 628_14, 629_1, 629_10, 629_11, 629_2, 629_3, 629_4, 629_5, 629_6, 629_7, 629_8, 629_9, 629_10, 629_11, 629_12, 629_13, 629_14, 629_15, 629_16, 630_1, 630_2, 630_3, 631_1, 631_10, 631_2, 631_3, 631_4, 631_5, 631_6, 631_7, 631_8, 631_9, 631_11, 631_12, 631_13, 631_14, 631_15, 632_1, 632_2, 632_3, 632_4, 632_5, 632_6, 632_7, 632_8, 632_9, 632_10, 632_11, 632_12, 632_13, 632_14, 733_1, 733_2, 733_3, 733_4, 733_5, 734_1, 734_2, 734_3, 734_4, 734_5, 735_1, 735_2, 735_3, 735_4, 735_5, 736_1, 736_2, 736_3, 736_4, 736_5, 737_1, 737_2, 737_3, 737_4, 737_5, 738_1, 738_2, 738_3, 738_4, 738_5, 739_1, 739_2, 739_3, 739_4, 739_5, 740_1, 740_2, 740_3, 740_4, 740_5, 741_1, 741_2, 741_3, 741_4, 741_5, 742_1, 742_2, 742_3, 742_4, 742_5, 743_1, 743_2, 743_3, 743_4, 743_5, 744_1, 744_2, 744_3, 744_4, 744_5, 745_1, 745_2, 745_3, 745_4, 745_5, 746_1, 746_2, 746_3, 746_4, 746_5, 747_1, 747_2, 747_3, 747_4, 747_5, 748_1, 748_2, 748_3, 748_4, 748_5, 749_1, 749_2, 749_3, 749_4, 749_5, 750_1, 750_2, 750_3, 750_4, 750_5, 751_1, 751_2, 751_3, 751_4, 751_5, 752_1, 752_2, 752_3, 752_4, 752_5, 753_1, 753_2, 753_3, 753_4, 753_5, 754_1, 754_2, 754_3, 754_4, 754_5, 755_1, 755_2, 755_3, 755_4, 755_5, 756_1, 756_2, 756_3, 756_4, 756_5, 757_1, 757_2, 757_3, 757_4, 757_5, 758_1, 758_2, 758_3, 758_4, 758_5, 759_1, 759_2, 759_3, 759_4, 759_5, 760_1, 760_2, 760_3, 760_4, 760_5, 761_1, 761_2, 761_3, 761_4, 761_5, 762_1, 762_2, 762_3, 762_4, 762_5, 763_1, 763_2, 763_3, 763_4, 763_5, 764_1, 764_2, 764_3, 764_4, 764_5, 765_1, 765_2, 765_3, 765_4, 765_5, 766_1, 766_2, 766_3, 766_4, 766_5, 767_1, 767_2, 767_3, 767_4, 767_5, 768_1, 768_2, 768_3, 768_4, 768_5, 769_1, 769_2, 769_3, 769_4, 769_5, 770_1, 770_2, 770_3, 770_4, 770_5, 771_1, 771_2, 771_3, 771_4, 771_5, 772_1, 772_2, 772_3, 772_4, 772_5, 773_1, 773_2, 773_3, 773_4, 773_5, 774_1, 774_2, 774_3, 774_4, 774_5, 775_1, 775_2, 775_3, 775_4, 775_5, 776_1, 776_2, 776_3, 776_4, 776_5, 777_1, 777_2, 777_3, 777_4, 777_5, 778_1, 778_2, 778_3, 778_4, 778_5, 779_1, 779_2, 779_3, 779_4, 779_5, 780_1, 780_2, 780_3, 780_4, 780_5, 781_1, 782_1, 782_2, 782_3, 782_4, 782_5, 783_1, 783_2, 783_3, 783_4, 783_5, 784_1, 784_2, 784_3, 784_4, 784_5, 785_1, 786_1, 786_2, 786_3, 786_4, 786_5, 787_1, 787_2, 787_3, 787_4, 787_5, 788_1, 788_2, 788_3, 788_4, 788_5, 789_1, 789_2, 789_3, 789_4, 789_5, 790_1, 790_2, 790_3, 790_4, 790_5, 791_1, 791_2, 791_3, 791_4, 791_5, 792_1, 792_2, 792_3, 792_4, 792_5, 793_1, 793_2, 793_3, 793_4, 793_5, 794_1, 794_2, 794_3, 794_4, 794_5, 795_1, 795_2, 795_3, 795_4, 795_5, 796_1, 796_2, 796_3, 796_4, 796_5, 797_1, 797_2, 797_3, 797_4, 797_5, 798_1, 798_2, 798_3, 798_4, 798_5, 799_1, 799_2, 799_3, 799_4, 799_5, 800_1, 800_2, 800_3, 800_4, 800_5, 801_1, 801_2, 801_3, 801_4, 801_5, 802_1, 802_2, 802_3, 802_4, 802_5, 803_1, 803_2, 803_3, 803_4, 803_5, 804_1, 804_2, 804_3, 804_4, 804_5, 805_1, 805_2, 805_3, 805_4, 805_5, 806_1, 806_2, 806_3, 806_4, 806_5, 807_1, 807_2, 807_3, 807_4, 807_5.

12. A conjugate comprising the oligonucleotide of any of claims 1, 2 and 8, and at least one conjugate moiety covalently attached to said oligonucleotide.

13. A pharmaceutical composition comprising the oligonucleotide of any of claims 1, 2 and 8 and a pharmaceutically acceptable diluent, solvent, carrier, salt and/or adjuvant.

14. An in vivo or in vitro method for inducing ubiquitin-protein ligase E3A (UBE3A) expression in a target cell where expression of paternal UBE3A is suppressed, said method comprising administering an oligonucleotide of claim 1 in an effective amount to said cell.

15. The method according to claim 14, wherein the expression of UBE3A is increased by at least 40% compared to a control.

16. The method according to claim 14, wherein the level of the SNHG14 transcript downstream of SNORD109B is reduced by at least 30% compared to a control.

17. The method according to claim 14, wherein the target cell is a neuronal cell.

18. The method according to claim 14, wherein the expression of SNORD115 is not significantly affected compared to a control.

19. A method for treating a disease comprising administering a therapeutically or prophylactically effective amount of an oligonucleotide of claim 1 to a subject suffering from or susceptible to Angelman syndrome.

20. The oligonucleotide of claim 1 for use in the treatment of Angelman syndrome.

21. The oligonucleotide of claim 1, wherein the oligonucleotide comprises SEQ ID NO: 626.

22. The oligonucleotide of claim 10, wherein the oligonucleotide comprises CMP ID NO: 626_7.

23. The oligonucleotide of claim 2, wherein the oligonucleotide consists of TTAcActtaattatactTCC (SEQ ID NO: 626) and pharmaceutically acceptable salts thereof, wherein capital letters represent beta-D-oxy LNA nucleosides, lowercase letters represent DNA nucleosides, all LNA C are 5-methyl cytosine, and all internucleoside linkages are phosphorothioate internucleoside linkages.

24. A pharmaceutical composition comprising the oligonucleotide of claim 23 and a pharmaceutically acceptable diluent, solvent, carrier, salt and/or adjuvant.

* * * * *